United States Patent 11,098,302 (IDENTIFICATION OF POLYNUCLEOTIDES ASSOCIATED WITH A SAMPLE) - sequence listing, part 116

SEQ ID NO: 400816 - DNA, 537 bp, Homo sapiens
  misc_feature: GZ8MTXP02HIJEF.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctagatctctgccgcctctactttgcaaagtggggtcccatcaaggtcagcggcagtgatctgggacagattcagtctcacatcagcagcctgcagcctgacgtattttcgactaacttactacttgaccctaagtcgactaataaataactacgtagtttacggggacgggtagggaaccgaaagggttacggaagagttaccgaaaacgaactgacggtctaggcgactatctgtacctctactttccc

SEQ ID NO: 400817 - DNA, 546 bp, Homo sapiens
  misc_feature: GZ8MTXP02I5SUS.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaaccgagggaaacgaccccaaaagtcctagatctctgccgcctctactttgcaaagtcggggtcccatcaaggtcagccgcagtgatctgggacagaattcagtctcaccatcagcacgcctgcagcctgacgtatttcgactaacttactactgacctaagtgactaataaataatctacgtttacgggacggaagggaccgaagggtcggaagtagtacgaaagaacggtaacgttggtacggtcgtcgaccaacctatccgtacggttcctttactacc

SEQ ID NO: 400818 - DNA, 549 bp, Homo sapiens
  misc_feature: GZ8MTXP02HEI8P.15.28.C06.1.454.CMB.2.raw
  modified_base (275)..(275): a, c, t, g, unknown or other
  modified_base (501)..(501): a, c, t, g, unknown or other
  modified_base (536)..(536): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaanccccaaaagtcctgatctctgccgcctctactttgactaaaagtcggggtcccatctaaggttcagccggcagtggatctggggacagattcagtctcaccatcagcagcctgcagcctgacgtatttttgacctaaactttacctacttcggaccctaaagttgacctaaataaactaatacctaagtttcgggacggtaggggacctaaaggggtcggaagtanacgaaaacgacgtggtacgctgctaccatccgttntacttctactccg

SEQ ID NO: 400819 - DNA, 547 bp, Homo sapiens
  misc_feature: GZ8MTXP02FUFD0.15.28.C06.1.454.CMB.2.raw
  modified_base (511)..(511): a, c, t, g, unknown or other
  modified_base (536)..(547): a, c, t, g, unknown or other
tcagtctacgtagccacgaccggtgctcgatttagagctcacgtattggggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaaacaacctgagagccgaggacacggctgtgtattactgtgtgagagatgttctggcggttggggccaggggaccctggtcaccgtctcctcagccctcaccgaacgggcccagtccggtccttcccccgtggcccgccctgcctccgacggcgccacccgtcgagacgcacgacgccggcccgtggggcctcgccgtggtacgaacggtacctacttccgacgtacgtacggacgtgaggccgggtcncgggacaacgggcgacgagtacgcnnnnnnnnnnnn

SEQ ID NO: 400820 - DNA, 556 bp, Homo sapiens
  misc_feature: GZ8MTXP02J2GVG.15.28.C06.1.454.CMB.2.raw
  modified_base (340)..(340): a, c, t, g, unknown or other
  modified_base (383)..(383): a, c, t, g, unknown or other
  modified_base (495)..(495): a, c, t, g, unknown or other
  modified_base (538)..(538): a, c, t, g, unknown or other
tcagtctacgtagccacgaccggtgctcgatttagagctcacgtattgggtttggagggaagaggaagactgaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaaggggctgggagtgggtggccacataacaaaaagntggaagtgacacaacctatgtcgaactctgtgatcggggcccnttccacccgtctccgagagacgacgccaaagaactcaactacatctagacaaatgaaacaactgagagccgaggacacgggtctgtgtattactgtgtgagagtatcgttcnggtcggttaggggccacggggaaccccttgggctacccggtcnccgtcacgccctccaccg

SEQ ID NO: 400821 - DNA, 570 bp, Homo sapiens
  misc_feature: GZ8MTXP02IRTYP.15.28.C06.1.454.CMB.2.raw
  modified_base (345)..(345): a, c, t, g, unknown or other
  modified_base (350)..(350): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaccaggaaacgaccccaaaagtcctagatctctcgccgcctctactttgcaaagtcgggtccatcaagtcagccgcagtgatcnggacngtattcagtctcacatcagcagctgcagcctgacgtatttcgacaactttacactcgacctaagttgactaaataaattaatactacgtttacgggacgggaggtaaccgaagggttacggaagtacttaaccgaaaaacggtaacgtaggtacggaccgttacggaaccgaccccgtaatttacccgtaggtttaccctttaccgtaacttttcccccg

SEQ ID NO: 400822 - DNA, 521 bp, Homo sapiens
  misc_feature: GZ8MTXP02FRJZU.15.28.C06.1.454.CMB.2.raw
  modified_base (386)..(386): a, c, t, g, unknown or other
  modified_base (419)..(419): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaacgccccaaaagtcctgatctctgccgcctctactttgcaaagtggggtcccatcaaggttcaggcgcagtggatctgggacagaattcagtctcacatcagcagcctgcagccngacgtatttgactaacttactactgaccaagtnacaataaataatctaagtttcggacggaggggaaccaaagggtcggaagagtacaaaacgaacgtgtcggctacgaacacctaatcgttgtctactactccg

SEQ ID NO: 400823 - DNA, 529 bp, Homo sapiens
  misc_feature: GZ8MTXP02GVXTQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaagaccccaaaagtcctagatctctcgccgcctctactttgacaaaaggtggggtcccatcaaggttcagcgcagtgatcgtgggacagaattcagtctcaccatcagcagcctagcagcctgacgtattttgactaacttactactgaccaagtgacaataaataatactagtttcgggacggaacgggaccgaaagggtcggaagatacgaaaacgaaactgtacggctggaacaccatcctgttctctacttcccg

SEQ ID NO: 400824 - DNA, 532 bp, Homo sapiens
  misc_feature: GZ8MTXP02HIKUV.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagccggcagtggatcgtgggacngaattcagtctcacatcagcagcctgcagcctagacgtattttgactaaacttactacttgaccctaaagtgactaattaaataattctaagtttcgggacggtaaggggaccaaggggtacggaagatacgaaaacgaacgtgtacggactgcaaccgtctctgtctactactcc

SEQ ID NO: 400825 - DNA, 525 bp, Homo sapiens
  misc_feature: GZ8MTXP02HDH0T.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaaccagggaaacgaccccaaaagtccagatctctcgccgcctctactttgacaaaagtggggtccatcaaggtcagccggcagtggatcgtgggacagaattcagtctcaccatcagcagcctgcagcctagacgtatttgactaacttactactgcctaaagtgacaataaactaatctagtttcgggacggagggaaccaaagggtggaagagtacaaaacgtaactgtacggctgccaacacgtctgtcttactacttcccg

SEQ ID NO: 400826 - DNA, 571 bp, Homo sapiens
  misc_feature: GZ8MTXP02GG696.15.28.C06.1.454.CMB.2.raw
  modified_base (410)..(410): a, c, t, g, unknown or other
  modified_base (559)..(571): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaaagaactcactacatctgcaaatgaaacaacctgagagccgaggacacgggctgtgtattactgtgtgagagatgttctggcggttggggccagggaccctggtccaccgtctcctcacgccctaccaaccgaacgggccccaagttcccgggtccttcccccgtgggcccncccctgcctcccgaaggacgcccacccgtccgagacgaccacgacggccggcccctgggggcctcggccctgggtaccaaacgggacttaaccgttccgacctacggtacgacgtggaggcgggcgtggaccgaaaggccgacagacgnnnnnnnnnnnnn

SEQ ID NO: 400827 - DNA, 558 bp, Homo sapiens
  misc_feature: GZ8MTXP02IXGC9.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtggcctggttcagcagaaaccagggaaagaccccaaaagtcctgatctctgccgcctctactttgacaaagtcgggtccatcaaggttcagccggcagtggatcgtggggacagtaattcagtctcaccatcagcagcctgcagcctgacgtatttcgactaacttactacttcgacctaagtcgactaaactaaattaattctaacggtttcgggacgggtaacggggaaccaaaggggttacggagtaactaacgaaaacgtaactcggtacggctgaaccgaacacttcagtttccttactactttcccg

SEQ ID NO: 400828 - DNA, 533 bp, Homo sapiens
  misc_feature: GZ8MTXP02IJGOJ.15.28.C06.1.454.CMB.2.raw
  modified_base (428)..(428): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaaagccccaaaaagtcctagatctctgccgcctctactttgcaaaagtcggggtcccatcaaggttcagccggcagtgatctgggacagaattcagtctcaccatcagcagccctgcagcctgacgtattttgactaacttactactgacctaagtnacaataaataatctagtttcggacggaagggaccaaagggtcggaaagtataacgaaaacgtactagtacggctagccaaccaatctgtccttacactttccccg

SEQ ID NO: 400829 - DNA, 547 bp, Homo sapiens
  misc_feature: GZ8MTXP02F2HGZ.15.28.C06.1.454.CMB.2.raw
  modified_base (361)..(361): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaacgaccccaaaagtcctgatctctcgccgcctctactttgacaaaggtcggggtcccatcgaaggttcagccggcagtggatcgtgggacngaattcagtctacacatcagcagcctgcagcctgacgtattttcgactaactttactactagacctaaagtcgactaattaaatactactaacgtttcgggacgggtaacgggaccgaaagggtaggaagtactaacgaaaacggtacgtggtacgctagaacacgtatctgtacttcactttccc

SEQ ID NO: 400830 - DNA, 526 bp, Homo sapiens
  misc_feature: GZ8MTXP02FT7HU.15.28.C06.1.454.CMB.2.raw
  modified_base (430)..(430): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctgccgcctctactttgcaaaggtcggggtcccatcaaggttcagccggcagtggatcgtgggacagaattcagtcctcaccatcagcagcctagcagcctgacgtattttcgactaacttactactgccaagtnacaataataatctagttcggcggaagggtaccgaagggtcggagatacgaaaacgtactggtagctgaaccactacgtctacgtcttcacttcccg

SEQ ID NO: 400831 - DNA, 516 bp, Homo sapiens
  misc_feature: GZ8MTXP02IFZ03.15.28.C06.1.454.CMB.2.raw
  modified_base (172)..(172): a, c, t, g, unknown or other
  modified_base (389)..(389): a, c, t, g, unknown or other
  modified_base (394)..(394): a, c, t, g, unknown or other
  modified_base (415)..(415): a, c, t, g, unknown or other
  modified_base (420)..(420): a, c, t, g, unknown or other
  modified_base (488)..(488): a, c, t, g, unknown or other
  modified_base (504)..(516): a, c, t, g, unknown or other
tcagtctacgtagccacgaccggtgctcgatttagagctcacgtattgggtttggggggtccctgagactctcctgtgaagcctctggattcaccttgagcactttattggatgacttgggtccgccaggctccagggaaggggctggagtgggtgccaccatacaaaaagntggaagtgacacaacctatgtgaactctgtgatggggccattcaccgtctccagagacgacgccaagaactcactacatctgacaaaatgaacaacctgagagccgaggacacggctgtgtattactgtgtgagagatgttctgcggttggggccagggaaccctggtcaccgtctcctcacgcctccaccgaagggcccatccggtccttcccccnggccncccctgctccaggagccaccncgagnacacagccgccctggggctgccgtggtacaaggacctacttcccgctacgtacgagaggcggcgtcgngacggacgcgaacagnnnnnnnnnnnnn

SEQ ID NO: 400832 - DNA, 572 bp, Homo sapiens
  misc_feature: GZ8MTXP02H4BEP.15.28.C06.1.454.CMB.2.raw
  modified_base (198)..(198): a, c, t, g, unknown or other
  modified_base (265)..(265): a, c, t, g, unknown or other
  modified_base (347)..(347): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagagtcaccatcacttgccgggcagtcagagtattactaatggtgctgttcagcagaacaggaanaccccaaagtctgatctctgccgcctctactttgacaaaggtcggggtccatcaaggtcagccggcagtgatcgtagggacngaattcagtctacaccatcagcagcctgcagtcctgacgtatttcgactaacttactactcgacctaaagttcgactaattaaataacttacgtacgtttcgggacgggaacgggaaccgaaggggttacggaaagtaacgtaacgaaaacggtaacgttaggtacgggtactacggaaccgtaaccgtaacttccgttagttccctttactaacgtttcccccg

SEQ ID NO: 400833 - DNA, 575 bp, Homo sapiens
  misc_feature: GZ8MTXP02FNBL0.15.28.C06.1.454.CMB.2.raw
  modified_base (375)..(375): a, c, t, g, unknown or other
tcagtctacgtagccacgaccggtgctcgatttagagctcacgtattggggtttgggggagtcagactcagtcaggacacagcatggacatggacgggtccccgctcagctccgtggggctcctgctgctctggctcccaggtgaccaaatgtgacatccagatcgacccagtctccgtccacctgtctgcatctgtcggagacagagtcaccatcacttggcccgggccagtcagagttattactaatggttggcctggttcagcagaaaccgagggaaacgaccccaaaagtcctgatctctcgcccgcctctactttgacgtaaaggtcggggtaccatcgaaaggttcagccggacagtggatcgtggacngtaatcagtctcacatcagcacgctgcagccctagacgtattttcgactaaccttactaacttgacctaagtcgaactaataaaactaatcttaagtttcgggacgggaacgggtaccgaaagggtcggaagataacgaaaaccgaacgtcggtaaggcttacggctaaacgtactcttggttacctactactttccccg

SEQ ID NO: 400834 - DNA, 525 bp, Homo sapiens
  misc_feature: GZ8MTXP02JBL0J.15.28.C06.1.454.CMB.2.raw
  modified_base (358)..(358): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctagatctctgccgcctctactttgcaaagtggggtcccatcaaggttcagccggcagtggatctggggacngaattcagtctcaccatcagcagcctgcagcctgacgtattttgactaacttactacttgaccaagtgactaataaataatctagtttcgggacgggagggaccgaagggtacggagaatacgaaaacgaacgtgtacggctgcacacttctgtcttcactttcccg

SEQ ID NO: 400835 - DNA, 572 bp, Homo sapiens
  misc_feature: GZ8MTXP02JA0OM.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggtgctggttcagcaagaaccgaggaaacaccccaaaagtcctagatctctcgccgcctctactttgactaaaggtcggggtccatacaaggttcaggccggcagtggatcgtaggacagtacttcagtctacacatcagcacgcctcgcacgcgtacgtacgtactttactactaaccttaactaccttacgaccgaagtacgtactaattaaataaactacgtaacgttacgggtacgggaacgggaaccgaaagggtacggaagacgtaacgaaacgtaacgtagtacgtcgtacgaacgactaactctacgttaccttactacttcccg

SEQ ID NO: 400836 - DNA, 515 bp, Homo sapiens
  misc_feature: GZ8MTXP02I0OMC.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctgccgcctctactttgcaaagtgggtccatcaggtcagcgcagtgatctgggacagattcagtctcaccatcagcagcctgcagcctgacgtatttgactaacttactactcgaccaagtgactaataaataatctagtttcggacgggtaagggaccgaagggtcggaagtatacgaaaacggactggtacggctgccacatctgtacttcacttcccg

SEQ ID NO: 400837 - DNA, 594 bp, Homo sapiens
  misc_feature: GZ8MTXP02JZQUH.15.28.C06.1.454.CMB.2.raw
  modified_base (355)..(355): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggttggcctggttcagcagaaacaggaaacgccccaaaagtcctgatctctgccgcctctactttgacaaagtggggtcccatcaaggttcagccggcagtggatcgtgggacngatcagtctcacatcagcagccctgcagcctgacgtacttttgacctaacttactactagacctaagtcgactaaataaactaacttacgaagtttacgggacgggtacggggtaaaccgaaaaggggttcgggaaagtacgtaaccgtaaaaaacggcctttagggacgggtaccttaacggaaccgtaaacccgtaacttaccgttacggtttcctttaacctacggttttcccccg

SEQ ID NO: 400838 - DNA, 516 bp, Homo sapiens
  misc_feature: GZ8MTXP02FZL8G.15.28.C06.1.454.CMB.2.raw
  modified_base (356)..(356): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgccccaaaagtcctgatctctgccgcctctactttgcaaagtggggtccatcaaggtcagccggcagtggatcgtgggacngaaattcagtctcaccatcagcagctgcagcctgacgtattttgactaacttactactgaccaagtgacaataaataatacagtttcggcggaagggtaccaagggtcggagatacgaaaacgactagtcggctagcaccatcgtgtcttacactttccc

SEQ ID NO: 400839 - DNA, 500 bp, Homo sapiens
  misc_feature: GZ8MTXP02FL5HZ.15.28.C06.1.454.CMB.2.raw
  modified_base (494)..(500): a, c, t, g, unknown or other
tcagtctacgtagccacgaccggtgctcgatttagagctcacgtattgggtttgggggtccctgagactctcctgtgaagcctctggattcaccttgagcacttattggatgacttgggtccgccaggctccagggaatgggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccaggggaccctggtcaccgtctcccctcagcctccaccaagggcccatccggtcttccccctggccgccctgctccaggacgcacctccgagagcacagcggcccctggggctgcctggtccaagggactactccgctacgtagactgagcgggctgggcaaggcgcatagnnnnnnn

SEQ ID NO: 400840 - DNA, 597 bp, Homo sapiens
  misc_feature: GZ8MTXP02H2ZEF.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggcagtcagagtatactaaatggttggcctggttcagcaagaaaccgaagggaaacgaccccaaaagtcctagactctctcgccgcctctactttgacaaggtcgggtaccatacgtaaggttcaggccggcgaggtggatcgtagggacaggtaattcagtcctacaccatcgagcagcctgcacgcctagacgtatttacgactaaacttactactgacctagtacgactataaatatacgtagtttacgggacgggtaacgggaaccgtaagggtaggaaaggtaacgtaacgaaaaacggtaacgtcggtacggtacgttacggaacccgtaaccgtaacttacgttcggttacctttaccgtacctttcccccg

SEQ ID NO: 400841 - DNA, 591 bp, Homo sapiens
  misc_feature: GZ8MTXP02H8B6L.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtggctggttcagcagaaacaggaaacgcccaaaagtcctgatctctgcccgcctctactttgactaaaaggtcggggtcccatcgaaaggttcagccggcgagtgagtctgggacagaagttacagtctacacatcacgacagcctgcacgccgtgacgtactttggactaaacttacttactacgacctaagtgtactaataaataaacttactacgttacgggtacggaagggtaaccggaaagggttacggaagtacgtaacgaaaacggtaaaccgtaggttcggacgttacggaacgtaacccgtaacgttctacggtttaccttaccgttaactttccccg

SEQ ID NO: 400842 - DNA, 640 bp, Homo sapiens
  misc_feature: GZ8MTXP02HTWZQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtcaccctgtctgcatctgtcgagacagagtcaccatcacttgccgggccagtcagagtattactaaatggttgcctggttcagcagaacaggaagcccaaaagtcctgatctctgccgcctctactttgactaaaaggtcggggtcccagtactaaaggttcaggcccggcaggttggatcgttgggacagtaaatttcaagtctacaccatcaagcagccctgcagcctgacgtattttcgactaaacttactaactgtaccctaaaggttgactaaattaaattaaactctaaacgttttacgggggaccggtaaacgggggaaaccctaaaagggggttcgggaaaacgttaagtaaaccgaaaaacccgtaaaacggtttgggtaaccggggtctacggggtaacccgtaaaccccgaaagttccccttaggtttacccctttaccgtaaacttttccccccgg

SEQ ID NO: 400843 - DNA, 520 bp, Homo sapiens
  misc_feature: GZ8MTXP02HYDNM.15.28.C06.1.454.CMB.2.raw
  modified_base (356)..(356): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagccggcagtggatctgggacnggaattcagtctcaccatcagcagcctgcagccctgacgtatttcgactaacttactactcgcctaaagtgacaataaataatctagtttcggacgggaggaccgaagggtggaagatacaaaacgaactgtacggctgaacacatctgtcttactacttcccg

SEQ ID NO: 400844 - DNA, 536 bp, Homo sapiens
  misc_feature: GZ8MTXP02JM6WV.15.28.C06.1.454.CMB.2.raw
  modified_base (527)..(527): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaacccagggaaacgaccccaaaagtcctagatctctcgccgcctctactttgacaaaggtcggggtcccatcaaggttcagccggcaggtgatcgtggggacaggaattcagtctcacatcagcacgcctggcagccctgacgtattttcgactaaacttactacttcgacctaaagtcgactaataactaatctagtttcggacgggtagggacagggtagagatacgaaagaacgtgtacggctagaacaccgtatccgttntctctactc

SEQ ID NO: 400845 - DNA, 499 bp, Homo sapiens
  misc_feature: GZ8MTXP02FOI16.15.28.C06.1.454.CMB.2.raw
  modified_base (357)..(357): a, c, t, g, unknown or other
  modified_base (444)..(444): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaaagtggggtccatcaaggttcagccggcagtggatctgggacngaattcagtctcaccatcagcagcctgcagcctgacgattttgactaacttactactgaccaagtgacaataaataatcatttcggngagggacaaggtgagatacaaaacgactagtggctgcacatctgtctcacttccc

SEQ ID NO: 400846 - DNA, 589 bp, Homo sapiens
  misc_feature: GZ8MTXP02GSWDW.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtgctgttcagcagaacaggaaacgaccccaaaagtcctgatctctcgccgcctctactttcgactaaaggtcggggtcccagtacgaaggttcagccggcagtggatcgtagggaacagtaattcgacgtctacacatcagcagcctgcagccctgacgtatttcgactaacttactactgacctagtcactaataaataattactacgtttcgggacgggtaacggggtaccgtaaaggggtaggaacggaaacgttaacgaaaaccggagttacggtacgggtccttacgggaaccgtaacccgtaattccggttacgttcctttaccgaacttttcccccgg

SEQ ID NO: 400847 - DNA, 610 bp, Homo sapiens
  misc_feature: GZ8MTXP02H11MD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtcctgcatctgtcggagacagagtcaccatcacttgccgggccagtcagagtattactaaatggtggcctggttcagcagaaaccagggaaacgaccccaaaagtcctagatctctcgcccgcctctactttgacgtaaagtcggggtacccatcgtaaggttcacggccggactaggtggattcgtaggggacaggtaattcagtctacaccatcagcacgcctgcagccctgaacgttatttcgactaacttactacgtcgacctaaagttgactaaataaataactacgttacgtttacggggacggtaaggggaaacctaaaggggtcggaagtaaacgttaccgaaaaacggtaaacgttgggtacggtaccttacggaacctacgtaacttccgtcgttacctttccgtaactttcccccg

SEQ ID NO: 400848 - DNA, 554 bp, Homo sapiens
  misc_feature: GZ8MTXP02I7CXB.15.28.C06.1.454.CMB.2.raw
  modified_base (295)..(295): a, c, t, g, unknown or other
  modified_base (354)..(354): a, c, t, g, unknown or other
  modified_base (387)..(387): a, c, t, g, unknown or other
  modified_base (389)..(389): a, c, t, g, unknown or other
  modified_base (391)..(391): a, c, t, g, unknown or other
  modified_base (393)..(393): a, c, t, g, unknown or other
  modified_base (433)..(433): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagatattactaaatggttgctggttcagcagaacagggaaacacccaaaagtccagatctctcgccncctctactttgactaaaggtcggggtcccatcgaaaggttcagccggcagtggattcgngggacagaattcagtctcacatccagctagccncncncnctcgtacgtacttactactacttactactacgactagtanactaataataatactacgttacggtacggacggaacggaaggtacggagaacgtaaacgtaaacgtaacgtacgtacggtacgtacgaacgacgtacgtacgttacgttcttactactccg

SEQ ID NO: 400849 - DNA, 603 bp, Homo sapiens
  misc_feature: GZ8MTXP02IS1O2.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttgctggttcagcagaacaggaaacgaccccaaaagtcctagatctctgccgcctctactttgacgtaaagtcggggtccagtcgtaggtcagccgcagtgatcgtggacngtaattcagtctcacatcaagctacggcctgcacgtctagtaacgtatttcgactaacttaacctactacgacctaaagtcgactaaataaactaactacgttaacggtttaccgggacggggtaacgggtaaaccgtaaaagggggttacggaaacggtaacgttaaacgaaaaacggtaccgttacggtagggtaccctaggaacccgaacgtaacttccgtaacgtcctttactaccgtttacccccg

SEQ ID NO: 400850 - DNA, 548 bp, Homo sapiens
  misc_feature: GZ8MTXP02JNTTL.15.28.C06.1.454.CMB.2.raw
  modified_base (354)..(354): a, c, t, g, unknown or other
  modified_base (379)..(380): a, c, t, g, unknown or other
  modified_base (382)..(382): a, c, t, g, unknown or other
  modified_base (424)..(424): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgcctggttcagcagaaaccagggaaacgccccaaaagtcctagatctctgccgcctctactttgacaaagtggggtcccatcaaggtcagccgcagtgatctgggacngaattcagtctcacatcagcagccnncngctcgacgtattacgtactaacttactactacgactaagtanactaataaataatacgtacgttacggtacgggacgggtaacgtaaggtacggaagaacgtaaacgaaacgtaaacgtacgtacggtacgtacgaacgactactactacgttacttactactccg

SEQ ID NO: 400851 - DNA, 534 bp, Homo sapiens
  misc_feature: GZ8MTXP02G2BNN.15.28.C06.1.454.CMB.2.raw
  modified_base (429)..(429): a, c, t, g, unknown or other
  modified_base (522)..(522): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaaccaggaaacgaccccaaaagtcctagatctctcgccgcctctactttgacaaaggtcggggtcccatcgaaggtcagccggcagtgatcgtagggacagtaattcagtctacaccatcagcacgcctgcagctgacgtatttgactaacttactactgaccaagtnactaataaataatcgtaagtttcgggacggaacgggaccgaagggtacggaagagtaacaaaacggtaactggtacgctagaacaaccatctntcttcacttccc

SEQ ID NO: 400852 - DNA, 529 bp, Homo sapiens
  misc_feature: GZ8MTXP02H6R5Q.15.28.C06.1.454.CMB.2.raw
  modified_base (253)..(253): a, c, t, g, unknown or other
  modified_base (370)..(370): a, c, t, g, unknown or other
  modified_base (378)..(378): a, c, t, g, unknown or other
  modified_base (381)..(381): a, c, t, g, unknown or other
  modified_base (428)..(428): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttnagcagaaacaggaacgacccaaaagtcctgatctctcgccgcctctactttgactaaaggtcggggtcccatacgaaggttcagccggcagtggatcgtgggactagaattcagtcncacatcancancctgcagcctgacgtatttcgactaacttacctactcgacctaagtnactaataataatctagttcgggacggagggacgaagggtgagtactaacgaaacgtacgtgtacggctcggaacacctaatcctgttcttactacttcccg

SEQ ID NO: 400853 - DNA, 540 bp, Homo sapiens
  misc_feature: GZ8MTXP02F08XQ.15.28.C06.1.454.CMB.2.raw
  modified_base (421)..(421): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaacaggaaagccccaaaagtcctagatctctgccgcctctactttgactaaagtcggggtcccatcaaggttcagccgcagtgatcgtagggacagaatcagtctcacatcagcagcctgcagctgacgtatttgactaacttactactcgaccaagtnacaattaaatatactagtttacgggacggtaagggaaccgaagggtacggaggaactacgaaaacgtactacggtacggctacggaacacccgattccgttgttccttctactttcccg

SEQ ID NO: 400854 - DNA, 600 bp, Homo sapiens
  misc_feature: GZ8MTXP02I03ZX.15.28.C06.1.454.CMB.2.raw
  modified_base (373)..(373): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggttggctggttcagcagaaaccgaggaaacgaccccaaaagtcctagatctctcgcccgcctctactttgacgaaaaggtcggggtcccatacgaaggttcagccgcagtgatcgtagggacagaattcagtcncacatcagcagcctgcacgcctagacgtatttcgactaacttacgtactagtaccctaagtcgactaattaaactaatactaacgtttccgggacggaacggggtaaccgaaaggggttaggaaacgtaacgtaaaccgaaaaaccggtaaacgtggttacgggaccgttaggaaccgtaacccttaacggttccttaacggtttccctttacaaccttttcccccg

SEQ ID NO: 400855 - DNA, 602 bp, Homo sapiens
  misc_feature: GZ8MTXP02GLWAW.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttgctggttcagcagaaccaggaaagaccccaaaagtcctgatctctgccgcctctactttgacaaaggtcggggtcccatcgaaggttcaggccggcagtggatcgtggggacagtaattcagtctacaccatcagcagcctgcagcctgacgtattttgactaactttactactgacctaaagtgactaattaaactaattcgtagtttaccggggacgggtaacggggaaccgtaaaggggttagggaaacgttaacgtaaacgtaaaaccgggaaacgtttcggggtaacgggccttacgggcccgtaaaccgtaacttcgtttaccgtttacctttacgaaccttttcccccgg

SEQ ID NO: 400856 - DNA, 541 bp, Homo sapiens
  misc_feature: GZ8MTXP02JYHO7.15.28.C06.1.454.CMB.2.raw
  modified_base (359)..(359): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctagatctctgccgcctctactttgacaaagtggggtcccatcaaggtcagccggcagtggatcgtgggacngaattcagtctcacgatcagcagcctgcagcctgacgtatttgactaacttactacttgccaaagtgacctaattaaataaatctaagtttcgggacggtacgggaaccaaagggtggaacgataacgaaaacggtactaggtacgggactaggccaccattctagtcttacactttccccg

SEQ ID NO: 400857 - DNA, 548 bp, Homo sapiens
  misc_feature: GZ8MTXP02JJLVP.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaagccccaaaagtcctgatctctgccgcctctactttgacaaaggtggggtccatcaaggttcagccggcagtggatcgtagggacagtaattcaagtctcaccatcagcagcctgcagcctgactattttgactaacttactactcgaccaagtgactaaataaataatctaacgtttcggggaacggacgggtaaccgaagggtacgggagaacgtaacgaaaacggtacgtggtacggctacgctaaccgattcgtgtacctttcactttccccg

SEQ ID NO: 400858 - DNA, 596 bp, Homo sapiens
  misc_feature: GZ8MTXP02HEBJC.15.28.C06.1.454.CMB.2.raw
  modified_base (457)..(457): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaagtggttggcctggttcagcaagaaaccgaggaaacgaccccaaaagtcctagatctctcgcccgtcctcttactttagacgtaaacggtcgggtaccagtacgaaggttcagccggcaggtggatcgtagggacagaattcacgtctccacatcacgcacgcctgacacgcgtagacgttatttcgactaacttactaccttacggactaagttanactaaattaaactatcgtaagtttcgggagggaacggtaaccgtaaggtacggaaagacgttaaacgaaaaccggtaaacgtggtacggacgtacgaaccgtacgtacttcgtacgtttccttactactttacccccgg

SEQ ID NO: 400859 - DNA, 554 bp, Homo sapiens
  misc_feature: GZ8MTXP02HMN00.15.28.C06.1.454.CMB.2.raw
  modified_base (348)..(348): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggcagtcagatatactaaatggttggcctggttcagcagaaaccaggaaagccccaaaagtcctagatctctgccgcctctactttgacaaagtggggtccatcaagtcagccgcagtgatgtggacngaattcagtctcacatcagcagcctgcagcctgacgtatttagactaacttactattacgaccgtaaagttcgactaataaataaacgttcgtaacgtttcgggacgggtacgggaaccgaaaggggttggaagtacaacgtaaaacggacgtaggtacgtctacggtaacaacccgtagttaccgtgtccttactactttccccg

SEQ ID NO: 400860 - DNA, 618 bp, Homo sapiens
  misc_feature: GZ8MTXP02G8ONB.15.28.C06.1.454.CMB.2.raw
  modified_base (282)..(282): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtgcctggttcagcagaacaggaacaccccaaaagtccngatctctgccgctctactttgcaaaggtggggtccatcaaggttcagccgcagtggatcgtggacagaacttcagtctcacatcagcagcctgcacgcctagactattttagacctaaactttacctacgtacgaccctaaaggtcgactaaattaaaacttaataccgttaagttttaccggggaccgggtaaaggggtaacccgaaaaggggttacggggaaacgtaaacgttaaaaccggaaaaacgggtaaacgtttacggggtacggaccttacgggaacccgtaactaccgttacgttcggttaccctttacggttaaacctttcccccg

SEQ ID NO: 400861 - DNA, 537 bp, Homo sapiens
  misc_feature: GZ8MTXP02I9KNE.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggttggcctggttcagcagaaaccagggaaagaccccaaaagtcctagatctctcgccgcctctactttgacaaaggtcggggtccatcaaggttcagccggcagtggatcgtgggacagattcagtctcacatcagcagcctgcagctgacgtatttgacctaacttactactgacctaagtcgactaataataatcagtttcgggacggtaagggaccaagggtggaagtataacgaaaacgtaactggtacgctaggaaccgaactagttctagttaccttctaactttccccg

SEQ ID NO: 400862 - DNA, 610 bp, Homo sapiens
  misc_feature: GZ8MTXP02GNF7K.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaacaggaaagaccccaaaagtcctagatctctgccgcctctactttgacaaagtcggggtccatcaaggttcagccggacagtggatcgtagggacagaattcagtctcaccatcagcagcctgcagcctgacgtatttcgacctaactttactaacttggaccctaaagtgacctaaattaaattaaacttcgtaagttttaccggggacgggtaaacgggggtaacccgtaaaggggttagggaaacgaagttaaaaccggaaaaccggtaaaccgttagggttacgggccttacggaacctaacccgtaattccgttacggtttactttaccgtaactttcccccg

SEQ ID NO: 400863 - DNA, 655 bp, Homo sapiens
  misc_feature: GZ8MTXP02IBODP.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattaactaaagtggttggcctggttcagcaagaaaccgaggaaacgaccccaaaagtcctgatcctctcgccgcctctactttgactaaaggtcggggtacccagtcaaaggttcagcccggcagtggatcgtggggactagtaatttcagttcctacgaccatccgacgcaacgcctgccagcctagacgttatttcgacttaacttaactacgttacgacctaagtacgtactaaattaaactaaacttacgtaacggtttacggggaacggggtaacggggaaaccggtaaaaggggttacgggaaaacggtaacgttaaaccgaaaaacggtaaaccgttagggttaccgggaccttacgggaacccgaacgttaaacttaccgttacggttttcccgttacctttaacctttcccccg

SEQ ID NO: 400864 - DNA, 548 bp, Homo sapiens
  misc_feature: GZ8MTXP02HXMD6.15.28.C06.1.454.CMB.2.raw
  modified_base (276)..(276): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagagtcaccatcacttggccgggccagtcagagtatactaaatggttggcctggttcagcagaaacagggaaanaccccaaaagtcctagatctctgccgcctctactttgcaaagtcggggtccatcaaggttcagccggcagtggatcgtgggacaggaattcagtctcacatcagcagcctgcagcctgacgtattttcgactaaactttactacctggaccctaaagtcgacaataataaactctaaagtttcgggacggaggggaccgaaagggtcggaagtataaccgaaaacgaacgtggtcggaactggaacctacactcgtatctttacactttccc

SEQ ID NO: 400865 - DNA, 536 bp, Homo sapiens
  misc_feature: GZ8MTXP02HDMVG.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggtgctggttcagcagaacaggaaacgaccccaaaagtcctagatctctgccgcctctactttgcgaaagtcggggtccatcgaaggttcagccggcagtggatcgtgggacagaattcagtctcacatcagcagcctgcagctagacgtatttcgactaacttactactgacctaagtgactaattaataactctagtttcggacgggtagggaaccgtaagggtagagaatacgaaaacgacgtaggtcggtactacgaaccacgtactcgttgtcctttacacgtttccccg

SEQ ID NO: 400866 - DNA, 585 bp, Homo sapiens
  misc_feature: GZ8MTXP02I4Z3L.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctagatctctgccgcctctactttgcaaagtggggtcccatcaaggtcagcggcagtgatctgggacngaattcagtctcacatcagcagcctgcagcctgacgtattttgactaacttactactgaccctaagtcgactaataaataatctagtttacgggacgggtaaggggaacccgaaaggggttacggaagtaagttaaccgaaaaacggtaaaccgttagggtaacggggtccttacgggaaccgaaacccgtaacttcccgttacggttacctttccgaaacttttcccccg

SEQ ID NO: 400867 - DNA, 730 bp, Homo sapiens
  misc_feature: GZ8MTXP02H92VU.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagtagtattaactaaagttggtggccttggttcagcaagaaaccgaagggaaacgaccccaaaagtcctagatctcgtcgacccgcctactacgtttgacgtaaaaggtcggggtacccagtacgtaaaggttcgaggccccggtcgtaaggtcgggaattccgtaggggactagtaaacgtttacacgttacctaccaacctataccgaacgacccgaacggtcccttacgaccgacgtacccgttacggtaaccgtttaagtttttccgaccctttaaaaccttaccttaaaccgttcgtaacccgtaaaggttacgactaaagttaaataaacttacgtaacggtttccggggaacggggaacggggttaaccgaaaagggggttcggaaaacgttacggtaaaaccgaaaacggtaaccgttagggtacgggtaacttacgggaacccgttaacgtaacttaccgttcggtttaccctttaccttaaccgtttcccccg

SEQ ID NO: 400868 - DNA, 585 bp, Homo sapiens
  misc_feature: GZ8MTXP02F9VFI.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtggacagtccaaggatgacccagtctccgtccaccctgtctgcatctgtcggagacagagtcaccatcacttgccgggcagtcagagtattactaaatggttgctggttcagcagaacaggaaacaccccaaaagtccagatctctcgccgccttctactttgactaaaaggtcggggtacccatcgaaaggttcaggcccggcagtggattcgagggacaggtatcagtctcacatcagcacgcacgcacgcgtcgtacgttagtttacgtactaacttaacttactacgtacgtaacgtacgtactaataaactaactacgttacgttacgggtacggaacgggaacggtaaggtacggaagtaacgtaaacgtaaacgtaacgtacgtacggtacgtacgaacgtacgtacgtacttcgttacttactacgtccg

SEQ ID NO: 400869 - DNA, 518 bp, Homo sapiens
  misc_feature: GZ8MTXP02JP6RL.15.28.C06.1.454.CMB.2.raw
  modified_base (347)..(347): a, c, t, g, unknown or other
  modified_base (352)..(352): a, c, t, g, unknown or other
  modified_base (420)..(420): a, c, t, g, unknown or other
  modified_base (506)..(506): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaaagtgggtcccatcaaggtcagccgcagtgatcgnggacngaattcagtctcaccatcagcagcctgcagcctagacgtattttgacaaacttactactgaccaagtnacaataaataatcctaagtttcggacggtaagggaaccaagggtcggaaggtatacgaaaaccgaacttgaggctgaacacatctntcttcatttccc

SEQ ID NO: 400870 - DNA, 592 bp, Homo sapiens
  misc_feature: GZ8MTXP02JW1XM.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattactaaatggttggcctggtttcagcagaaaccgagggaaacgaccccaaaagtcctagatctctgcccgcctctactttgcaaagtcggggtccatcaaggttcagcccggcagtggatcgtggggacagtaattcacgtctacacatcgagcaacgcctgcacgccgtgacgtattttcgactaaacctttactactcgaccgtaagtgacctaaattaaactaacttactaacggttttcggggacgggtaacggggaaccgtaaggggttcggaaagtaacgtaccgaaaaccgtaacgtgtacggcgttacggaacctacccgtattccttcgtaccttctactttccccg

SEQ ID NO: 400871 - DNA, 719 bp, Homo sapiens
  misc_feature: GZ8MTXP02GZI35.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacgttcggccggcagtcagtagtattactaagtggttgcctgttcagacagaaacgaggaaacaccccaaagtcctagatctcgtcgcccgtccttacttacgtttcgaccgtaaaagggtccggggtaccctagtaccgtaaggttcgaggcccggacgtaggtggactcggtaggggaactagtaaacttcacgttcctaccactactcgaacgccacgtcccgtagaccgtaacgtccgtaggtaacgtttacgttttacgaaccttaaacctttaccgtaaccgtacggtaaccctaaaggttactaacttaaaattaaaacttaacgttaccggtttaaacgggtttaccgggggaaccgggttaaacggggaacccggttaaaaggggtacgggaaaacggtaaacgttaaaccggaaaacggtaaccgttgggtaccggtccgttacggaaccctaaacgtacttaccggttcgttacctttccgtaccgttttcccccg

SEQ ID NO: 400872 - DNA, 603 bp, Homo sapiens
  misc_feature: GZ8MTXP02IXA7D.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggccagtcagagtattactaatggttgcctggttcagcagaacgaggaaacgaccccaaaagtcctagatctctcgccgccctcttactttgactaaacggtcggggtcccatcgaacggttcaggccggcagtggatcgtagggacagtattcagtcctcactatcagcagcctgcagcctgactagtttcgactaacttactacttcgacctaagttgacaattaaactaaacttcgtaagttttaccggggacgggtaacggggaaccgtaaagggttacgggaagtaacgttaaccgaaaaaccggtaaccgttgggttacgggccgttacggaacccgtaaaccctagttccgttagttccctttactacttttccccg

SEQ ID NO: 400873 - DNA, 541 bp, Homo sapiens
  misc_feature: GZ8MTXP02FPHI7.15.28.C06.1.454.CMB.2.raw
  modified_base (462)..(462): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgaggggaggggctggagtgggtggccacatacaaaagatggaagtgacacaacctatgtgactctgtgatgggccgattcaccgtctcctcagcctccaccaacgggcccatccggtccttccccctggccgccctgctccagggacnccacctccgagacgcacgagccggccctggggcctggccctggtcaacggctactccgctacgtagactgacgcgggcg

SEQ ID NO: 400874 - DNA, 520 bp, Homo sapiens
  misc_feature: GZ8MTXP02GQN06.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagccccaaaaagtcctgatctctgccgcctctactttgcaaaagtggggtcccatcaaggttcagccggcagtggatctggggacagaattcagtctcaccatcagcagcctagcagcctgacgtattttgactaacttactactgaccaaagtgacaataaataatctatttcgggacggaagggtaccgaagggtggaagatacgaaaacgactagtcggctgcacactctgtctacacttccc

SEQ ID NO: 400875 - DNA, 567 bp, Homo sapiens
  misc_feature: GZ8MTXP02HRBV7.15.28.C06.1.454.CMB.2.raw
  modified_base (357)..(357): a, c, t, g, unknown or other
  modified_base (425)..(425): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtattactaaatggttggcctggttcagcagaaaccaggaaagaccccaaaagtcctagatctctgccgcctctactttgacaaagtggggtcccatcaaggttcagccgcagtgatctgggacngaattcagtctcaccatcagcagcctgcagctgacgtatttgactaacttacttactgacctaaagtntacaataaataatactaagtttcgggacggtaacgggaccaaagggttcggaaaggtataaccgaaaaacggtaaaccgttggttaacgggccttggaaccgaaccgtaattcccttaggttcctttactaactttcccccg

SEQ ID NO: 400876 - DNA, 544 bp, Homo sapiens
  misc_feature: GZ8MTXP02IF2PI.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaaacaggaaagccccaaaagtcctgatctctgccgcctctactttgacaaagtggggtccatcaagtcagcgcagtggatctgggacagaattcagtctcacatcagcagcctgcagcctgacgtatttgactaacttactacttcgacctaagtcgactaataaataatctaagtttcgggacggtaagggaccgaaagggtcggaagtaacgtacaaaaacggaaccgtaggtacggtacacgaaccgtaactacttacgttacttccttactacgtttccccg

SEQ ID NO: 400877 - DNA, 580 bp, Homo sapiens
  misc_feature: GZ8MTXP02IKGRM.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttgctggttcagcagaacaggaaagaccccaaaagtcctgatctctgccgcctctactttgactaaaagtcggggtcccatcaaggttcagccggcagtggatcgtggggacaggtaattcagtctcacatcagcagcctgcagcctagacgtattttacgactaacttaactacttgaccctaaagtcgtactaaataaattaactactaagtttacggggacggtaacggggaaccgtaaagggtacggaagtaaataccgaaaaacggaacgttggtacgggtactacggaacgaacccgtaagttccttacgttcctttactaactttccccg

SEQ ID NO: 400878 - DNA, 526 bp, Homo sapiens
  misc_feature: GZ8MTXP02HXFSW.15.28.C06.1.454.CMB.2.raw
  modified_base (262)..(262): a, c, t, g, unknown or other
  modified_base (372)..(372): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatatactaatggtgctgttcagcagaacaggaaanccccaaaagtcctagatctctgccgcctcttactttgactaaaaggtcggggtccatcaaggttcagccggacagtgatcgtggacagtaattcagtctacaccatccancagcctagcagcctgacgtatttgactaaacttatactagacctaagtgacaaattaaataatactaagtttcgggacggaagggaccaaagggtcgaaggtaacacgaaaacgacgtagtcggctagaacacgactctgtcttctacttcccg

SEQ ID NO: 400879 - DNA, 630 bp, Homo sapiens
  misc_feature: GZ8MTXP02GXHMZ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccccgtctgcatctgtcggagacagagtcaccatcacttgccgggccagtcagagtattactaaatggttggcctggttcagcaagaaaccgagggaaacgaccccaaaagtcctagatctctcgcccgcctctactttgacaaaaggtcggggtacccatacgaaaggttcaggcgccagtggatcgtgggacagattcagtctacacctatcagcagcctcgacacgccgtcgtacgtatttagtactaaacttaacctaactacgtaccgtaagtagtacctaataaattaaattaactaacgtttacgggtacggggaacggggaaccggaaagggtaagggaacggaaagttaaacgtaaaaccgaaacgtacggttagggtcgtacggaccgaacccgtaaacgttaccgttacgttaccgtttccttaaccttaccctttcccccg

SEQ ID NO: 400880 - DNA, 583 bp, Homo sapiens
  misc_feature: GZ8MTXP02GB5L7.15.28.C06.1.454.CMB.2.raw
  modified_base (433)..(433): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttggcctggttcagcaagaaaccgagggaaacgaccccaaaagtcctagatctctcgcccgcctcctactttgactaaaggtcggggtcccatcgaaggttcagccggcagtggatcgtgggacagaatcagtctcacatcagcagcctgcagcctgacgtatttgactaacttactactgaccaagtnacaattaaactaatcgtagtttccgggacgggtaacggggaaccgtaaggggttagggaagtaacgtaaaccgaaaaacggtaacctggggttacggcgttacgaaccgtaaccgtaacttccgttcgttacctttactacctttccccg

SEQ ID NO: 400881 - DNA, 508 bp, Homo sapiens
  misc_feature: GZ8MTXP02IMSOZ.15.28.C06.1.454.CMB.2.raw
  modified_base (264)..(264): a, c, t, g, unknown or other
  modified_base (277)..(277): a, c, t, g, unknown or other
  modified_base (344)..(344): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggtgctgttcagcagaacaggaanacccaaaagtccngatctctgccgcctctactttgacaaaggtcggggtacccatcgaaggttcagccgcagtggatcgngggacagaattcagtctacacatcagcagcctgcagcctgactatttgactaacttactactgacctaaagtgactaataaatatactagtttcggacggaggaccgaaggtgaagatacaaaacgaactggtacgctagccacattcgtgtctctacttcccg

SEQ ID NO: 400882 - DNA, 517 bp, Homo sapiens
  misc_feature: GZ8MTXP02GAF6A.15.28.C06.1.454.CMB.2.raw
  modified_base (173)..(173): a, c, t, g, unknown or other
  modified_base (387)..(387): a, c, t, g, unknown or other
  modified_base (399)..(399): a, c, t, g, unknown or other
  modified_base (405)..(405): a, c, t, g, unknown or other
  modified_base (507)..(517): a, c, t, g, unknown or other
tcagtctacgtagccacgaccggtgctcgatttagagctcacgtattggggtttgggggggtccctgagactctcctgtgaagcctctggattcaccttgagcacttattggatgacttgggtccgccaggctccagggaagggctggagtgggtggccaccatacaaaaagntggaagtgacacaacctatgtgaactctgtgatgggccgattcaccgtctccagagacgacgccaaagaactcactacatctgcaaatgaaacaacctgagagccgaggacacgggctgtgtattactgtgtgagagatgtctgcgttggggccaggggaaccctggtcaccgtctcctcagcctcaccagggcccagtcggtctcccctgccnccctgctccagngcaccncgagagcacagccgccctgggctcgccgtggtacaaggactacgttccgacctacgtacgactggacgcggggctgggacgaaacggcgcgaagtaggcgcnnnnnnnnnnn

SEQ ID NO: 400883 - DNA, 540 bp, Homo sapiens
  misc_feature: GZ8MTXP02JIZDH.15.28.C06.1.454.CMB.2.raw
  modified_base (198)..(198): a, c, t, g, unknown or other
  modified_base (280)..(280): a, c, t, g, unknown or other
  modified_base (436)..(436): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatcccagatgacccagtctccgtccaccctgtctgcatctgtcgganacagagtcaccatcacttgccggccagtcagagtattactaatggttgctgttcagcagaacaggaacaccccaaaagtccngatctctcgccgtcctctactttgacgaaaaggtcggggtacccatccgtaaggtcagcccggcaggtgatcgtgggacaggtattcagtcctacaccatcaacgcacgcctgcagcctgacgtattttcgactaacttactactcgacctaagtnacaataaatatactacgttcggcggaaggaccgaagggtcggagacgtacaaacgtacgtgtacggctgccaactactacgtctacttacgttactttaccccg

SEQ ID NO: 400884 - DNA, 534 bp, Homo sapiens
  misc_feature: GZ8MTXP02FNISE.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttgctggttcagcagaacaggaaacgaccccaaaagtcctagatctctgccgcctctactttgacaaaagtcggggtcccatcaaggttcagccggacagtggatcgtgggaacagaattcagtcctcacatcagcagcctgcagcctgacgtatttgactaacttactactgaccaagtgacaataataatctaagtttcggacggtaagggaccgaagggtagagaatacgaaaacgaacgtagtacggctagaactaccaacttccgtagttccttcactttccccg

SEQ ID NO: 400885 - DNA, 623 bp, Homo sapiens
  misc_feature: GZ8MTXP02ISJA3.15.28.C06.1.454.CMB.2.raw
  modified_base (449)..(449): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggtgctggttcagcagaacaggaaacaccccaaaagtcctagatctctcgccgcctctactttgactaaaggtcggggtacccagtcgtaaggttcaggtcccggacaggtggacgttcgtacggggaacaggtaacttcgacgtcctacaccatcagcacgccgtgcagcctgacgtatttgactaaacttactactgacctaagtnactaataaataatactagtttacgggacggtaacggggaaccgaaaggggttagggaaacgtaaacgttaaaccgaaaaaacggtaaccgttacgggttacggaccgttacggaacccgtaaaccctaacggtttacccttcggtttaccctttaccgtaaccttttcccccgg

SEQ ID NO: 400886 - DNA, 642 bp, Homo sapiens
  misc_feature: GZ8MTXP02HKZ3F.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagccaccatcacttcgccgggcagtcagagtattactaaatggttgcctggttcagcaagaaccagggaaacgaccccaaaagtcctagactctctcgcccgccttcttactttcgacgtaaaacgggttcggggtaccctagtaccgtaaggttcgaaggcccggacgtaggtcggtatcgtaggggaacaggtaacttacgagttcctaccaaccatcgacgcacgtccagccacgtcctggaacgttacttttgacctaaactttactaccttacgacccgtaaggtcaactaattaaactacttacgtaacgtttacggggacgggtaaacgggaaccgaaaggggttggaacgtaacgtaaacgtaaaacggtaaacgtgggtacgacgttacggaactaccgtaacttcgttcgttaccttcgtaactttccccg

SEQ ID NO: 400887 - DNA, 529 bp, Homo sapiens
  misc_feature: GZ8MTXP02FPIL4.15.28.C06.1.454.CMB.2.raw
  modified_base (389)..(389): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaaagtggggtcccatcaaggttcagccggcagtgatctgggacagaattcagtctcacatcagcagcctgcagccngacgtattttcgactaaacttactaactcgacctaagttgacaataaataactactagtttcgggacggaagggaccaaaagggtggaagatacgaaaacgtactcgtaggctaggcaccagtctgtcttcactttcccg

SEQ ID NO: 400888 - DNA, 620 bp, Homo sapiens
  misc_feature: GZ8MTXP02GELKA.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccggcagtcagagtattactaagtggtgctggttcagcagaacgaggaacaccccaaagtcctgactctctcgcccgtcctctacgtttgacgtaaaggtcggggtaccctagtacgtaaggttcgacggccggacgaggtggacgtcgtagggacagtaactctacgtctaccacatcacgcacgcctagcacgtcctagtacgttactttcgacctaactttactactcgacctaagtcgactaaattaataactacgtaggttacgggacgggtaacgggaaccgtaagggtacggaaagtaacgtaaccgtaaaaccggtacgtacgggtacgggtactaccggaacctaaccggtaactttaccggttcgttacctttaccgtacttttacccccgg

SEQ ID NO: 400889 - DNA, 521 bp, Homo sapiens
  misc_feature: GZ8MTXP02G36GS.15.28.C06.1.454.CMB.2.raw
  modified_base (427)..(427): a, c, t, g, unknown or other
  modified_base (508)..(508): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaacgccccaaaagtcctgatctctgccgcctctactttgcaaagtggggtcccatcaaggttcagccggcagtggatcgtggggacagaattcagtctcaccatcagcagcctagcagcctgacgtattttcgactaacttacactgaccaaagtnacaataactaaatctagtttcgggacggaagggaccgaaggttacggagatacgaaaacgaactgtacggctgcacatctntctacactttccc

SEQ ID NO: 400890 - DNA, 521 bp, Homo sapiens
  misc_feature: GZ8MTXP02FRD2W.15.28.C06.1.454.CMB.2.raw
  modified_base (273)..(273): a, c, t, g, unknown or other
  modified_base (349)..(349): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaccagggaaanaccccaaaagtcctgatctctgccgcctctactttgcaaagtgggccatcaaggtcagccgcagtgatcgtggacngattcagtcctcacatcagcagcctgcagcctagacgtatttcgactaacttactactcgaccaagtcgacaataaactatcgtagtttcgggcggtaagggaccgaaggtacggagaatacgaaaacgactggtcggactgaactaccagttctagttctcgactttcccg

SEQ ID NO: 400891 - DNA, 552 bp, Homo sapiens
  misc_feature: GZ8MTXP02F9200.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctagatctctcgcccgcctctactttgacaaaagtcggggtcccatcaaggttcagccggcagtgatcgtgggacagaattcagtctcacatcagcagcctgcagcctgacgtattttgactaacttactactgaccctaagtgactaataaataatctaagtttcgggacgggtaagggaccgaaagggtacggaagaattacgaaaaacggtaactggtacggctacggaaccaaccaattcctagttcttccactttccccg

SEQ ID NO: 400892 - DNA, 515 bp, Homo sapiens
  misc_feature: GZ8MTXP02HVUB2.15.28.C06.1.454.CMB.2.raw
  modified_base (274)..(274): a, c, t, g, unknown or other
  modified_base (286)..(286): a, c, t, g, unknown or other
tcagtctacgtagccacgaccggtgctcgatttagagctcacgtattgggtttggggggagtcagactcagtcaggacaaagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccagggaaancccaaaagtccngatctctgccgctctactttgacaaagtgggtcccatcaaggtcagcggccagtgatctgggacagattcagtctcacatcagcagcctgcagcctgacgtattttgactacttactactgaccaagtgacaataataaatctaatttcgggacggaacggggaccaaaggggtggaagagtacaaaacgactgtcggctgcaacctatctcgtcttctatccttcccg

SEQ ID NO: 400893 - DNA, 523 bp, Homo sapiens
  misc_feature: GZ8MTXP02GFIEM.15.28.C06.1.454.CMB.2.raw
  modified_base (364)..(364): a, c, t, g, unknown or other
  modified_base (378)..(379): a, c, t, g, unknown or other
  modified_base (381)..(381): a, c, t, g, unknown or other
  modified_base (384)..(384): a, c, t, g, unknown or other
  modified_base (415)..(415): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacaggaaacgccccaaaagtcctgatctctgccgcctctactttgcaaagtcgggtccatcaaggttcagccgcagtggatcgtgggacagattcagtctnaccatcagcagccnncngcngtagtattagactactactactcgacagtanactaataataatactacgttacggacgggacggaacgaaggtacggagaacgtaacgtaaacgaacgtacgtacgacgtacgaacgactactactcgtcttctactcg

SEQ ID NO: 400894 - DNA, 565 bp, Homo sapiens
  misc_feature: GZ8MTXP02HLKAC.15.28.C06.1.454.CMB.2.raw
  modified_base (353)..(353): a, c, t, g, unknown or other
  modified_base (430)..(430): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccggccagtcagatatactaatggttggctgttcagcagaaccgaggaacgacccaaaagtcctgatctctcgccgcctctactttgacgaaaggtcggggtaccatacgaaggttcagccggcagtggatcgnggacagacttcagtctacacatcagcacgcctgcagcctagtacgtatttacgactaacttactactgaccgtagtnacaattaactatactacgtttccgggagggtacgggacgtaaggggtacggaagacgtaacgaaaacggtacgtacggtacggtactacggaaccgtacgtaacttccgttacggttaccttactacctttcccg

SEQ ID NO: 400895 - DNA, 565 bp, Homo sapiens
  misc_feature: GZ8MTXP02FM2T0.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcaagaaaccaagggaaacgaccccaaaagtcctagatctctgccgcctctactttgcaaaagtggggtccatcaaggtcagccggcagtggatcgtgggacagaaattcagtctcacatcagcagcctgcagcctagacgtattttcgactaaactttaactactagacccaaagtgacaaattaaattaaatctaagtttcgggacgggaagggaccgaaagggtaggaagaagtaacgaaaacggaacgtaggtacggacgttacggaaccaaccgtatacttcgttacctaccgtactttccccg

SEQ ID NO: 400896 - DNA, 551 bp, Homo sapiens
  misc_feature: GZ8MTXP02HCLDG.15.28.C06.1.454.CMB.2.raw
  modified_base (538)..(538): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcaagaaaccagggaaacgaccccaaaagtcctagatctctcgcccgccttctactttgaccgtaaaaggtcggggtacccatccgaaggttcagccggacaggtgatcgtggggactaggaattcagtctacaccatcagcacgccctgacagccctagacgtattttcgactaaacttactactcgaccaaagtcgactaataaatacttacacgtttccggagggacggaacgaaggtacgggatactaacgaaagacgtgtacgctagcacgattctntcttcactttccc

SEQ ID NO: 400897 - DNA, 622 bp, Homo sapiens
  misc_feature: GZ8MTXP02HGIG8.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaacgaccccaaaagtcctgatctctgccgcctctactttgacaaaggtcggggtccatcgaaggttcagcccggacaggtggatcgtaggggacaggaactttcacgtcctacacatcagcagcctgcagcctagacttatttcgactaaacttactactcgacctaagtcgactaattaaaataacgttacgttaacgtttacggggacgggtaaacgggggaaaccgtaaagggggttacggaaaggtaaagtaaaccgaaaaacggtaaccgttagggtcgggaccttacggtaacccgaacccgtaagtttccgtacggtttaccctttaccgtaaccgtttcccccg

SEQ ID NO: 400898 - DNA, 613 bp, Homo sapiens
  misc_feature: GZ8MTXP02HA6KR.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggcagtcagagtatactaagtggtgctgttcagcagaacaggaacacccaaagtctagatctctcgccgtccttctacgtttcgacgtaaacgggtcggggtaccctagtacgtaaggttcgacggccggacgtaggtacggatcggtacggggaacaggtaacttcgacgttcctaccaaccataccagcacggcctgacacgtcctagtacgttagtttacgaccttaacttactacgtacgaccgtaagtcgactaaataaattaacgtcgttaacggttacgggacgggtaacgggtaaccgtaagggtaggaagtaactaacggtaaaacgtacgtggtacgcgtacgaaccgtaactacgttctacgttaccttactacctttccccg

SEQ ID NO: 400899 - DNA, 531 bp, Homo sapiens
  misc_feature: GZ8MTXP02JWOGQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctagatctctcgccgcctctactttgacaaagtcggggtccatcaaggttcagccgcagtgatcgtgggacagaattcagtctcaccatcagcagcctgcagcctgacgtattttcgactaactttactactgcctaaagtgactaaataaataatctaagtttcgggacgggtaagggaccgaagggtggaagatacgaaacgactggtcgactcgaacgaccatctgtcttacactttcccg

SEQ ID NO: 400900 - DNA, 604 bp, Homo sapiens
  misc_feature: GZ8MTXP02HSDX1.15.28.C06.1.454.CMB.2.raw
  modified_base (199)..(199): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctggtcgganacagagtcaccatcacttcggccggccagtcagtagtattaactaaagttggttggccgttggttcagacaagaaaccgaagggaaacgaccccgaaaagtcctagtatctctcgccgcctcttactttgacgtaaagggtcgggtacctagtacgtaaggttcgaggcccggacgtaggtggtacgtcggtaggggaacagtaacttcagtcctacaccatcgagcacgctgacacgtcctgtacgttatttcgactaacttactactacgacctaagtcgactaataaataactctagttcgggacgggtacggacgaagggtagaaggtactaaacgaaaacggtacgtggtacggtacgtcgaacctaccgtattcgtcgtttaccttactacgtttcccc

SEQ ID NO: 400901 - DNA, 513 bp, Homo sapiens
  misc_feature: GZ8MTXP02FGJW0.15.28.C06.1.454.CMB.2.raw
  modified_base (341)..(341): a, c, t, g, unknown or other
  modified_base (364)..(364): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgatctctgccgcctctactttgcaaagtgggtcccatcaaggttcagccggcagnggatctgggacagaatcagtctnacatcagcagcctgcagcctgacgtattttgactaacttacactgccaaagtgacataactaaatctaagtttcggacgggaagggaccgaaagggtggaagatacaaaacgaaacgtgtaggctagcacctatccttgtctacactcc

SEQ ID NO: 400902 - DNA, 537 bp, Homo sapiens
  misc_feature: GZ8MTXP02FZYCG.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcagaaaccagggaaacgaccccaaaagtcctagatctctcgccgcctctactttgacaaaggtcggggtcccatcaaggtcagcccggcagtggatcgtagggacagattcagtctcacatcagcacgcctagcagcctgacgtatttgactaacttactactacgactaaggtacactaattaaactaatacgtagtttcgggacgggtaacgggaacgaagggtcggaagagtaacgaaacgtactcgtcggactgaacacatctgtctacacttcc

SEQ ID NO: 400903 - DNA, 548 bp, Homo sapiens
  misc_feature: GZ8MTXP02HFT87.15.28.C06.1.454.CMB.2.raw
  modified_base (438)..(438): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtggctggttcagcagaacaggaaacaccccaaaagtcctgatctctcgccgcctctactttgactaaaggtcgggtacccatacgtaggttcaggcccggacagtggatcgtagggacagtaattcagtctacaccatcagcacgcctgcagcctagacgtattttcgacttaacttactctacgacctaagtnactaattaaatactacgtacgttcgggacggaacgggtacgaagggtacggagactaaccgaaagtacgtggacgtctacgaactaccattctacgtcttcactttcccg

SEQ ID NO: 400904 - DNA, 586 bp, Homo sapiens
  misc_feature: GZ8MTXP02IZLI2.15.28.C06.1.454.CMB.2.raw
  modified_base (348)..(348): a, c, t, g, unknown or other
  modified_base (373)..(373): a, c, t, g, unknown or other
  modified_base (379)..(379): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggagcctcgtccaggccggggggtccctgagactctcctgtgaagcctctggattcaccttgagcacttattggatgacttgggtccgccaggctccgaggggaagggctggagtgggtggccaccataacaaaagntaggaagtgaccacaacctatgtanaactcngtgatggggccgattcaccgtctccgagacgacgacgaccaagaaactcaactacatctacgacaaaatgaaaacctaaccgtggacgagacccgaggtacccaggctgtagtattacgtgtagtaggagaagtacttggttacctgggtccggttgggggaccctaacgggggtaacccccttgggaccctacccggtctaccccg

SEQ ID NO: 400905 - DNA, 542 bp, Homo sapiens
  misc_feature: GZ8MTXP02I6LNM.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggcctggttcagcagaaaccagggaaacgaccccaaaagtcctagatctctgccgcctctactttgcaaagtggggtccatcaggtcagccggcagtggatcgtgggacaggaattcagtctcacatcagcagcctgcagcctgacgtatttcgactaacttactactggacctaagtgacaaataaactaatactagtttccggggagggaacggggaacgaaggggtggaacgtaatacgaaaacgtaacgtggtacggctagaaccgtacctatcttcgtcttacactttcccg

SEQ ID NO: 400906 - DNA, 545 bp, Homo sapiens
  misc_feature: GZ8MTXP02GS0Q3.15.28.C06.1.454.CMB.2.raw
  modified_base (291)..(291): a, c, t, g, unknown or other
  modified_base (372)..(372): a, c, t, g, unknown or other
  modified_base (375)..(375): a, c, t, g, unknown or other
  modified_base (416)..(416): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggccagtcagagtattactaaatggttagcctggttcagcagaaaccaggaaagaccccaaaagtcctgatcnctgccgctctactttgcaaagtgggtccatcaagtcagcggcagtgatcgtgggacagtatcagtctcacatcagcagccngcngctgtacttatttcgactaacttactactacgtactaagtnactaataatacttcgtaggttacgggacggtaagggaacgtaaggtacggaacgtagtaaacgaaaacgtacgtacggtacgtacgtacgaaccgtaccgtagttcgtacgttacttacgtactttccg

SEQ ID NO: 400907 - DNA, 552 bp, Homo sapiens
  misc_feature: GZ8MTXP02I4CE8.15.28.C06.1.454.CMB.2.raw
  modified_base (252)..(253): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaatggtgctgttcnncagaacaggaacgaccccaaagtcctagatctctgccgcctctactttgactaaacggtcggggtacccatcgaaggttcaggccggcaggtgatcgtagggacagattcgagtctcacatcagcagcctgcagcctgacgtattttcgactaacttactactcgacagtcgtactaataataatcgtacgtttcgggacgggaaggacgaagggtcggaagtagtaaaccgaaacgaacgttggtacggaccgttagcgtaaccctagttcgttcgtttaccttcctactttcccccg

SEQ ID NO: 400908 - DNA, 598 bp, Homo sapiens
  misc_feature: GZ8MTXP02IIO1K.15.28.C06.1.454.CMB.2.raw
  modified_base (455)..(455): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtggcctggttcagcagaaacagggaaacgccccaaaagtcctgatctctgccgcctctactttgactaaaggtcggggtacccagtacgtaaggttcaggtccggcaaggtcggtatcgtaggggaacaggtaacttacgacgtcctaccaccatacagcacggcctgcacgcctaggactatttcgactaacttactactgacctaagtnactaataataatactagttcgggacggtagggaaccgaagggtggaagtactaaacgaaaaccggtaaagttcggtaacgggtcttacggaaccgtaacctaacgttcccgttaaggtttcccttaccgtaactttcccccgg

SEQ ID NO: 400909 - DNA, 541 bp, Homo sapiens
  misc_feature: GZ8MTXP02GAZ52.15.28.C06.1.454.CMB.2.raw
  modified_base (361)..(361): a, c, t, g, unknown or other
tcagtctacgtagccacgaccggtgctcgatttagagctcacgtattgggtttgggggaggtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctgccgcctctactttgcaaaggtcggggtcccatcaaggttcagccggcagtggatcgtgggacngaattcagtctcaccatcagcacgcctgcagcctgacgtatttcgactaactttactactcgacctaagtgactaataaactaactactacgtttacgggacggtaacgggaccgtaagggtcggaagactaacgaaaacgacgtgtacgctacgcacctatctgttactcactttcccg

SEQ ID NO: 400910 - DNA, 561 bp, Homo sapiens
  misc_feature: GZ8MTXP02H6AAD.15.28.C06.1.454.CMB.2.raw
  modified_base (358)..(358): a, c, t, g, unknown or other
  modified_base (377)..(377): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgacccccaaaagtcctgatctctgccgcctctactttgcaaaggtggggtcccatcaaggttcagccggcagtgatctgggacngaattcagtctcacatcancagcctgcagcctgactattttgactaactttactactgaccctaagtgactaaattaataacttactagtttaccggggacggtaagggggaaccgaaggggttacggaagtaactacgaaaaaccgacttagggtacggcttacggccacccgtaatccgttgtcctttccactttcccccg

SEQ ID NO: 400911 - DNA, 627 bp, Homo sapiens
  misc_feature: GZ8MTXP02H13MH.15.28.C06.1.454.CMB.2.raw
  modified_base (198)..(198): a, c, t, g, unknown or other
  modified_base (251)..(251): a, c, t, g, unknown or other
  modified_base (414)..(414): a, c, t, g, unknown or other
  modified_base (467)..(467): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtcctcccgtccacctgtctgcatctggtcgganacagagtcacatcacttcggccggcagtcagtatataactaagtggtgctgtnagacaagaacgaaggaacaccaaagtccagactctctcgccgtcctattacttggaactaaggtcgggtaccagtacgaaggttcaggtccgacgtaggtaggacgttcggtacggggactagtaacttacgacgttacctaccacatcgagcgacgcctgcncgtacctaggtacttaacgtttcactaaacttcaacgtcgtaacgtaagttanactaaagttaaataaccgtagttaacgggttacgggaacgggacgggtaaaaccgaggggttacaaaggtacgtaaaccgtaaaacgggtgttacggggacttaccgcgtaacccgaacgtaacgttcccttagtttaccccttacgttaccgttccccg

SEQ ID NO: 400912 - DNA, 529 bp, Homo sapiens
  misc_feature: GZ8MTXP02HV38D.15.28.C06.1.454.CMB.2.raw
  modified_base (334)..(334): a, c, t, g, unknown or other
  modified_base (368)..(369): a, c, t, g, unknown or other
  modified_base (371)..(371): a, c, t, g, unknown or other
  modified_base (373)..(373): a, c, t, g, unknown or other
  modified_base (376)..(376): a, c, t, g, unknown or other
  modified_base (380)..(380): a, c, t, g, unknown or other
  modified_base (415)..(415): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccgggccagtcagagtatactaaatggtgctggttcagcagaaaccaggaaagcccaaaagtcctgatctctcgccgcctctactttgcaaagtgggtcccatacaaggtcagcccggnagtgatctagggacagaattcagtctcacatcannancngcncgcncgacgtattatactaactactactacgactagtanacaataataatactacgtacggacggacgggaacgaaggtacggagaagtaaacgaaacgaaacgtacgtacgtacgtacgaacgactacgtactacgttaccttactactccg

SEQ ID NO: 400913 - DNA, 570 bp, Homo sapiens
  misc_feature: GZ8MTXP02IDSLM.15.28.C06.1.454.CMB.2.raw
  modified_base (334)..(334): a, c, t, g, unknown or other
  modified_base (352)..(352): a, c, t, g, unknown or other
  modified_base (480)..(480): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttcctgtgctattttagaggtgtccagtgtgaggtgcaactggtggagtcgtgggggagcctcgtccgaggccggggggtcctgagactctcctgtgaagcctctggattcaccttgagctacttattggatgacgttgggccgcaggcctcgaggggagggctggaggtgggngccacataaacaaaaagntaggaagtgaacacaactatgtagactcgtgtagatcgggggcctattccacccgtctcctcacgccctcccaccgaacgggcccacgtccggttcctcccccgtgcccgccctgcctcccgagggcnccaccgtccgagacgcacgacggccgtcccgtgggctcgacccgtggtacaaacggtcctacgttccgactacgtagcctggcggcggcg

SEQ ID NO: 400914 - DNA, 536 bp, Homo sapiens
  misc_feature: GZ8MTXP02IL8OM.15.28.C06.1.454.CMB.2.raw
  modified_base (352)..(352): a, c, t, g, unknown or other
  modified_base (389)..(389): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacaggaaagaccccaaaagtcctgatctctgccgcctctactttgctaaagtggggtcccatcaaggttcagccggcagtggatcgtgggacngattcagtctcacatcagcagcctgcagcctgacgtntttgacaactttactactgaccctaagtcactaaataaattaactctaagtttacgggcggtaagggaccgaaagggtcggaagactacgaaaaacggaacgttggtacggctaggaacaccctattcgtgtctttacactttcccg

SEQ ID NO: 400915 - DNA, 513 bp, Homo sapiens
  misc_feature: GZ8MTXP02H1TKC.15.28.C06.1.454.CMB.2.raw
  modified_base (350)..(350): a, c, t, g, unknown or other
  modified_base (416)..(416): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggtggcctggttcagcagaaaccaggaaagccccaaaagtcctagatctctgccgcctctactttgcaaagtggggtccatcaagtcagccgcagtggatcgtgggacngaaattcagtctcacatcagcagcctgcagcctgacgtatttgctaactactactgacctaaagtnacaataataactcgtacgtcggacggaacggaacgaaggtagaagacaacgaaacgtacgtcgacgtctacgaacactactctagttctactactcc

SEQ ID NO: 400916 - DNA, 581 bp, Homo sapiens
  misc_feature: GZ8MTXP02IHDX8.15.28.C06.1.454.CMB.2.raw
  modified_base (254)..(254): a, c, t, g, unknown or other
  modified_base (278)..(278): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggtgctgttcagnagaacaggaagaccccaaagtccngatctctgccgcctctactttgacaaaggtcggggtaccatcgaaggttcaggccggacagtggatcgtagggacaggtaattcacgtacctaccacatcagcacggcctgcacgcgtagacgtattttacgacctaacttactacttgacctaagtcactaataataattacgtagtttcgggacggaacggggaaccgtaaaggggttacggaaagtaaacgtaacgtaaaacgaccgttaggtacggtactacggaaccgaaccgtacttacgtaggtttcctttacgtactttcccccg

SEQ ID NO: 400917 - DNA, 487 bp, Homo sapiens
  misc_feature: GZ8MTXP02I4DA6.15.28.C06.1.454.CMB.2.raw
  modified_base (171)..(171): a, c, t, g, unknown or other
  modified_base (314)..(314): a, c, t, g, unknown or other
  modified_base (379)..(379): a, c, t, g, unknown or other
  modified_base (383)..(383): a, c, t, g, unknown or other
  modified_base (389)..(389): a, c, t, g, unknown or other
  modified_base (394)..(394): a, c, t, g, unknown or other
  modified_base (403)..(403): a, c, t, g, unknown or other
  modified_base (405)..(405): a, c, t, g, unknown or other
  modified_base (409)..(409): a, c, t, g, unknown or other
  modified_base (417)..(417): a, c, t, g, unknown or other
  modified_base (420)..(420): a, c, t, g, unknown or other
  modified_base (447)..(447): a, c, t, g, unknown or other
  modified_base (456)..(456): a, c, t, g, unknown or other
  modified_base (474)..(474): a, c, t, g, unknown or other
  modified_base (476)..(487): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaagggctggagtgggtggccaccatacaaaaagntggaagtgacacaacctatgtgaactctgtgatgggccgatttcaccgtctccagagacgacgccaagaactcactacatctgcaaatgaaacaacctgagagccgaggacacggctgtgtattactgtgtgagagatgttcnggcgttgggccagggaccctggcaccgtctcctcagcctcacaggcccatccggtccttccccgngccncctgcncagcncaccgcgancncacngccgccgngcncgctgacacgactctcactacgagcgngacgcggcnggacgacggcactagagngnnnnnnnnnnnn

SEQ ID NO: 400918 - DNA, 543 bp, Homo sapiens
  misc_feature: GZ8MTXP02JCSJ1.15.28.C06.1.454.CMB.2.raw
  modified_base (349)..(349): a, c, t, g, unknown or other
  modified_base (355)..(355): a, c, t, g, unknown or other
  modified_base (373)..(373): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcagaaaccaggaaacgaccccaaaagtcctgatctctcgccgcctctactttgacaaaggtcgggtccatcaaggttcagccgcagtgatcngggacngatcagtctcaccatcancagcctagcagctgacgtatttgactaacttactactgtaccaagtgacaataaatactctagtttcgggaggaacgggtaccgaaagggtcggaaagtacgtaacgtaaaacgaacgtggtacggtcctagaaccgaacctattcctagttcctttacgactttccccg

SEQ ID NO: 400919 - DNA, 503 bp, Homo sapiens
  misc_feature: GZ8MTXP02HT823.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagccggcagtggatctgggacngaattcagtctcaccatcagcagcctgcagcctgacgattttgctaacttactactgccaagtgacataataatcagtttcggcgagggaccaaaggtgaagatacaaacgaactgtacggctgccacactctgtcttcactttccc

SEQ ID NO: 400920 - DNA, 612 bp, Homo sapiens
  misc_feature: GZ8MTXP02GO1D2.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacaggaaacaccccaaaagtcctgatctctcgccgcctctactttgacaaaggtcggggtccatcgaaggttcagccggcagtggatcgtagggacaggtaattcagtctaccacgatacacgcacgcctggccagccctagaccgtagtttttcgaccttaactttaacctactacgaccgtaaaggttcactaaataaactaattacgttagtttccgggaacgggtaggggaaccgtaaggggtacggaagtaacgtaacgaaaaccggtaacgtagggtacggtacgtacggaaccgtaaaacccgttacgttaccgttacgtttaccgttaccgttacgtttccccg

SEQ ID NO: 400921 - DNA, 550 bp, Homo sapiens
  misc_feature: GZ8MTXP02IJZLK.15.28.C06.1.454.CMB.2.raw
  modified_base (356)..(356): a, c, t, g, unknown or other
  modified_base (428)..(428): a, c, t, g, unknown or other
  modified_base (438)..(438): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgcctggttcagcagaaacaggaaacgacccaaaagtcctgatctctcgccgcctctactttgacaaaagtcggggtacccatacgaaggttcaggccggcagtggattcgngggaacagaacttcaagtctacaccatccagcagcctggacacgtctgaactatttcgactaacttactacngaccaagtanataataaataatactagtacggacggacggaacggaaggtacggaagaacgtaaacgaaacgaacgtacgtacgtacgtacgaacgactactactacgtacttactactccg

SEQ ID NO: 400922 - DNA, 541 bp, Homo sapiens
  misc_feature: GZ8MTXP02JVWG0.15.28.C06.1.454.CMB.2.raw
  modified_base (275)..(275): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtaccaaatgtgacatccagatgacccagtctccgtccaccctgtctgcatctgtcggagacagagtcaccatcacttgccgggccagtcagagtattactaaatggttggcctggttcagcagaaaccagggaaacnccccaaaagtcctgatctctgccgcctctactttgcgaaagtcggggtacccatcaaaggttcaggcggccagtgatcgtggacagattcagtctcaccatcagcagcctgcagcctagaccgtattttacgactaaacttactactgacctaagtcgactaataaataactactagtttcgggacgggtaagggaccgaagggtacggaagagtacaaaacgactgtacgctagacaaccgtatcgtctcttacacttcttcccg

SEQ ID NO: 400923 - DNA, 515 bp, Homo sapiens
  misc_feature: GZ8MTXP02FQDMT.15.28.C06.1.454.CMB.2.raw
  modified_base (361)..(361): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcatggtttcagtagaaaccaggggaaacgaccccaaaagtcctgatctctgccgcctctactttgacaaagtggggtcccatcaaggttcagccggcagtgatcgtgggacngattcagtctcacatcagcagcctgcagcctgacgtattttgactaacttactactgacccaagtgaccaataaataatctagtttcgggcggagggaccgaagggtaggagatacaaacgactgtcgctgccacatctgtactcactttcccg

SEQ ID NO: 400924 - DNA, 558 bp, Homo sapiens
  misc_feature: GZ8MTXP02GZZUN.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggccagtcagagtatactaatggtgctgttcagcagaacaggaacgaccccaaaagtcctagatctctcgccgccttctactttcgacgtaaaggtcggggtacccagtacgtaacggttcgaggcccggacaggtggaactcgtagggaactaggtaaacttcgacgtcctaccacctatcgagcacgcctgcacgcctagacgtatttcgactaaacttactactcgacctaagtcactaataaatatactagttcgggacggacggacgaaggtagagataacgaaacgtacgtcgtacggctacgaacgactactctacgtcttactacttcccg

SEQ ID NO: 400925 - DNA, 583 bp, Homo sapiens
  misc_feature: GZ8MTXP02JWLHZ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccgaggaaacgaccccaaaagtcctagatctctcgccgcctctactttgacaaagtcggggtccatcaaggttcagccggcagtgatcgtgggacagtaaattcacgtctacacatacagcagccctagcacgtccctagtacgttaagttttcgaccttaaacctttaacttaccgttaggacccctaaagtcgtacctaaataaacttaaatcgtaacgtttcggggaccgggtaagggaccgtaaagggtaggaacggactaacgaaaacggtaacttgggacgctcggaacaccagtctagtctcactttcccg

SEQ ID NO: 400926 - DNA, 545 bp, Homo sapiens
  misc_feature: GZ8MTXP02IIFT5.15.28.C06.1.454.CMB.2.raw
  modified_base (341)..(341): a, c, t, g, unknown or other
  modified_base (381)..(381): a, c, t, g, unknown or other
  modified_base (524)..(545): a, c, t, g, unknown or other
tcagtctacgtagccacgaccggtgctcgatttagagctcacgtattgggtttgggggaagaggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaaaaacctgagagccgaggacacggctgtgtattactgtgtgagagatgttctgcgttggggccagggaccctggtcaccgtctcctcacgcctccaccaagggccccagtccggtccttcccccgnggccgcccctgcctcccgaggacgccaccccgtcccgagngccaacacggccgggccccgtgggggcctcggcccccgttaggggtaccaaaagggtacccttaacctttcccgaccgttaaccgtaagaccgttggaacgggccggggtcgtcgggaccgaaaagggccgaccaaagtaggnnnnnnnnnnnnnnnnnnnnnn

SEQ ID NO: 400927 - DNA, 487 bp, Homo sapiens
  misc_feature: GZ8MTXP02HM8BJ.15.28.C06.1.454.CMB.2.raw
  modified_base (358)..(358): a, c, t, g, unknown or other
  modified_base (479)..(479): a, c, t, g, unknown or other
  modified_base (484)..(484): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgacaaaagtcggggtcccatcaaggttcagccgcagtggatctgggacngaaattcagtctcaccatcagcagcctgcagcctgacgattttgcaacttactactgaccaagtgcataatatcattcggcgaggacaaggtgagatcagacgaactgtggctgcacatcngtctntac

SEQ ID NO: 400928 - DNA, 564 bp, Homo sapiens
  misc_feature: GZ8MTXP02GQR66.15.28.C06.1.454.CMB.2.raw
  modified_base (439)..(439): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggtgctgttcagcagaaacaggaaacaccccaaaagtcctagatctctcgccgcctctactttgacgtaaaggtcggggtcccatacgaaggttcaggccggcagtggactcgtaggggaacaggtaattcagtcctacaacatacagcacgcctgacagcctagacgtatttcgactaacttactactagaccaagtnacaataaataatctagttcgggacggtaacgggacgaagggtacggaagtaacgtaacgaaaacggaacgtggtacggactacggaaccgtaactacttcgtcgttacttacctactttaccccg

SEQ ID NO: 400929 - DNA, 519 bp, Homo sapiens
  misc_feature: GZ8MTXP02JHHQG.15.28.C06.1.454.CMB.2.raw
  modified_base (345)..(345): a, c, t, g, unknown or other
  modified_base (383)..(383): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtgctgttcagcagaacaggaaagccccaaaagtcctgatctctgccgctctactttgcaaagtggggtcctatcaggttcagccggcagtggatcgtgggacngaattcagtctcacatcagcagcctgcagcctgacgtnttttgctaacttactacttcgacctaaagtcgactaataaataatactagtttcgggacggtaacgggaccgaaagggtcggaagagtacaaaaggtaactgtacggctagcgactactctgtctttacatttccc

SEQ ID NO: 400930 - DNA, 582 bp, Homo sapiens
  misc_feature: GZ8MTXP02JHZ24.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggttggctggttcagcaagaaaccgaggaaacgaccccaaaagtcctagatctctcgccgcctctactttgacgaaaggtcggggtcccatcgaaggttcaggccggcagtggatcgtgggacagaattcagtctcacatcagcacgcctgcagcctgaccgttattttcgacttaactttactacgtcgacctaagtcgactaataaataactacgtagtttcgggacgggaacgggtaccgaaggggtaggaagtacgtaaaccgaaaacgtaacgttaggtacggtacgtacggaacctaaccgtacttccgttcgttacctttaccgtactttccccg

SEQ ID NO: 400931 - DNA, 519 bp, Homo sapiens
  misc_feature: GZ8MTXP02FOLJJ.15.28.C06.1.454.CMB.2.raw
  modified_base (360)..(360): a, c, t, g, unknown or other
  modified_base (509)..(509): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctagatctctgcccgcctctactttgacaaagtggggtcccatcaaggttcagccggcagtggatctgggacngaattcagtctcacatcagcagcctgcagcctgacgtattttgactaactttactaactgacccaaagtgactaataataatctagtttcggacggaagggaccgaagggtacggagactacaaaacgactgtaggctgaacacatctntctctactcg

SEQ ID NO: 400932 - DNA, 521 bp, Homo sapiens
  misc_feature: GZ8MTXP02IIKEU.15.28.C06.1.454.CMB.2.raw
  modified_base (349)..(349): a, c, t, g, unknown or other
  modified_base (391)..(391): a, c, t, g, unknown or other
  modified_base (414)..(414): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccggcagtcagagtattactaatggttgctggttcagcagaacaggaaacgaccccaaaagtcctagatctctcgcccgcctctactttgcaaagtggggtcccatcaagttcagccgcagtgatcgtgggacngattcgagtctcacatcagcagcctgcagcctgacgtatttnactaacttacactagccgaagtnaccaataaactaagtactagtttccgggaggaacggaccgaagggtaggacgtatacaaaacgaactggtacggctagcaccaattctgttctttacactttccccg

SEQ ID NO: 400933 - DNA, 560 bp, Homo sapiens
  misc_feature: GZ8MTXP02FJL4I.15.28.C06.1.454.CMB.2.raw
  modified_base (387)..(387): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgctctactttgcaaagtggggtccatcaaggttcagccggcagtggatcgtggggacagaattcagtctcacatcagcagcctgcagccngacgtattttgactaacttactactgaccaagtgactaataaataaatctaagtttcgggacgggtaaggggaaccgaaaagggtacgggaagaagttacgaaaaacggtaacgtaggttacggacgttaggaaccgacccgtaatccttagttcctttactacgtttccccg

SEQ ID NO: 400934 - DNA, 606 bp, Homo sapiens
  misc_feature: GZ8MTXP02IDNTH.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttggcctggttcagcaagaaaccagggaaacgacccccaaaagtccctagactctctcgcccgcctctactttgactaaagtcggggtccagtacaaggttcagccggcagtggatcgtgggacagattcagtctcacatcagcagctgcagctgacgttatttagactaacttactacgtcgacctaagtcgtactaaactaaattaactacgttaagtttacggggaccggggtaagggggtaacccgaaagggggttaggaaacggtaactaaacggtaaaaaccggtaaacgttggtacgggtaccttaggaaccaacccgttaatccgtttaggttccctttacgtaccttttccccg

SEQ ID NO: 400935 - DNA, 634 bp, Homo sapiens
  misc_feature: GZ8MTXP02HHTOE.15.28.C06.1.454.CMB.2.raw
  modified_base (377)..(377): a, c, t, g, unknown or other
  modified_base (398)..(398): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagacccccaaaaagtcctagatactcgtcgccgcctctactttgacaaaaggtcggggtacccatcgtaaacggttcagcccggtacaggtcggatcgtgggacngtaattcagtctcacatcgancagcctgcagcctgacgtattttgactaacttacctactcggtaccctaagttcgacctaaattaaaactaaactacttaacgtttaccggggacgggtaaacggggaacccgtaaagggggttacggaaggtaacgttaaaccgaaaaacggtaaacgttaccggtaggggtacccttaggaacccgtaaaccgaactttccgtacggtttcccttacgttaaccgtttcccccg

SEQ ID NO: 400936 - DNA, 679 bp, Homo sapiens
  misc_feature: GZ8MTXP02J4A38.15.28.C06.1.454.CMB.2.raw
  modified_base (437)..(437): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagacgtcaaccatccacgttcggcccgggccagtcaagtagttattaacgtaaagtggttggtccttggttcagacaaacggaaaccgaagggaaacgaccccaaaagtcctagactctcgcgtccgcctcttacgttgacgaaaggtcggtacccagtacgtaacggttcgacggccggacgtaggtaggacttcggacggggaacacggtaattaccaacgttccaccaacctanccgagacccgagtccctacgaccgtacgtccgtagtaacgtttacttttacgacccttaactaccgttacgtacgaccgtaagtctaacctaaattaaactacgttacgtaacggtttacgggggacggaacgggtaaaccgtagggttaacggacgttaaacgtaacgaaaacggtacgtcggacgtaccgtagtaacccgtaacgtcttaccgttgttacccttaccgtacctttccccg

SEQ ID NO: 400937 - DNA, 580 bp, Homo sapiens
  misc_feature: GZ8MTXP02HGO1T.15.28.C06.1.454.CMB.2.raw
  modified_base (419)..(419): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccggccagtcagagtattactaatggttggcctggttcagacaagaaaccgaaggaaacgaccccaaaagtcctagactctctcgcccgcctctactttgacgtaaaggtcggggtacccatacgaaggttcagccggacgagtggatcgtgggacagtaacttcagtctaccacatcagcacgcctgcacgctagacgttntttacgacctaacgtttactactcgacctaagtctactaattaattaactacgtagtttcgggacggaaggggtaccgaaggggtacggaagaactaacgaaacgacgtaggtacgcgttacgaaccactacgttcgtacttccttaccgtactttccccg

SEQ ID NO: 400938 - DNA, 582 bp, Homo sapiens
  misc_feature: GZ8MTXP02GI9E1.15.28.C06.1.454.CMB.2.raw
  modified_base (358)..(358): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttggctggttcagcagaaaccaggaaacgaccccaaaagtcctagatctctcgccgcctctactttgacaaaggtcggggtcccatcaaggtcagccggcagtgatcgtgggacngattcagtctcacatcagcagcctgcagcctgacgtattttgactaacttactactgacctaagtgactaataaataaatcgtaagtttcgggacgggtaacggggaaccgtaaagggtacggaagtaacgtaaccgaaaacggtaaccgttacggtaggaccttacgggaaccctaacccgtaagttcccttcggtttacctttaccgtaaccgtttcccccg

SEQ ID NO: 400939 - DNA, 515 bp, Homo sapiens
  misc_feature: GZ8MTXP02HT18L.15.28.C06.1.454.CMB.2.raw
  modified_base (342)..(342): a, c, t, g, unknown or other
  modified_base (356)..(356): a, c, t, g, unknown or other
  modified_base (498)..(498): a, c, t, g, unknown or other
  modified_base (502)..(502): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtattactaaatggttggcctggttcagcagaaaccagggaaagccccaaaaagtcctgatctctgccgcctctactttgcaaagtggggtcccatcaaggttcagccggnagtgatctgggacngaattcagtctcaccatcagcagctgcagcctgacgtattttgactaaacttactacttgacctaaagtgaccaataaataatccaatttcgggacggtagggaccaaggtcggaagatacaaaacgtactgtgctgcaacnctcngtccttcattccc

SEQ ID NO: 400940 - DNA, 541 bp, Homo sapiens
  misc_feature: GZ8MTXP02JQ4A1.15.28.C06.1.454.CMB.2.raw
  modified_base (286)..(286): a, c, t, g, unknown or other
  modified_base (331)..(331): a, c, t, g, unknown or other
  modified_base (350)..(350): a, c, t, g, unknown or other
  modified_base (479)..(479): a, c, t, g, unknown or other
tcagtctacgtagccacgaccggtgctcgatttagagctcacgtattgggtttgggggaagaggaagactgaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccncaggctccagggagggctggagtgggtggccaccatacaaaaagntggaagtgacacaacctangtgaactctgtgatgggccgattcaccgtctccagagacgacgccaaagacctcactacatctgaccaaatgaaacaacctgagacgccgaggaccacggctgtgtattacgtgtgtgagagatgttcngcggttggggccacggggacccctggtccaaccggtctcctcacgccctaccgacaaccggg

SEQ ID NO: 400941 - DNA, 550 bp, Homo sapiens
  misc_feature: GZ8MTXP02IMD5B.15.28.C06.1.454.CMB.2.raw
  modified_base (287)..(287): a, c, t, g, unknown or other
  modified_base (333)..(333): a, c, t, g, unknown or other
tcagtctacgtagccacgaccggtgctcgatttagagctcacgtattgggtttgggggaagaggaagactgaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccnccaggctccaggggagggctggagtgggtggccacataacaaaagntggaagtgacacaaacctatgtgaactctgtgatgggccgattcaccgtctccagacgacgacgccaaagactcactacatctagacaaaatgaaacaacctgaaagcgaccgaggacacggctgtagtattactgtgtgagagattgttctggtcgttgggggacctaggggaacccctgggtccaaccggtctcctcacgccctccacgaaccgg

SEQ ID NO: 400942 - DNA, 579 bp, Homo sapiens
  misc_feature: GZ8MTXP02ITJFW.15.28.C06.1.454.CMB.2.raw
  modified_base (278)..(278): a, c, t, g, unknown or other
  modified_base (361)..(361): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagagtatactaatggtgctggttcagcagaacaggaacaccccaaaagtccngatctctgccgcctctactttgcaaacgtgggtcccatcaaggttcagccgcagtgatctagggacagaattcagtcctcacntacagcagcctgcagcctgacgtatttcgactaacttactactgaccctaagtcgactaataaactaatacgtagtttaccggggacgggtaacgggtaaccgaaaggggttcggaaaggtaacttaaacgaaaaacggtaaacgttggttaacgggcttaacggaacccgtaaacccgtaagtttaccttcggttacctttccaacgttttcccccg

SEQ ID NO: 400943 - DNA, 616 bp, Homo sapiens
  misc_feature: GZ8MTXP02HAB3U.15.28.C06.1.454.CMB.2.raw
  modified_base (446)..(446): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacgaggaaacgaccccaaaagtcctagatctctcgccgccttctactttgacaaaggtcggggtacctagtacaaggtcaggccggacagtggatcgtgggacagaattcagtctacaacatacagcaacgcctgcagccctagacgtatttcgactaaacttactactagacctaaaggtanaactaaataaactaacgtactacggttacgggacgggtaaacgggaaccggtaaaagggtacggaaacgtaaacgtaaaaccgaaaaaccggtaacgtacgggtacggtacctacggaaccctaaaccgtaacgttaccgttacgtttacccttacctaccgtttccccg

SEQ ID NO: 400944 - DNA, 502 bp, Homo sapiens
  misc_feature: GZ8MTXP02IRAWH.15.28.C06.1.454.CMB.2.raw
  modified_base (382)..(382): a, c, t, g, unknown or other
  modified_base (387)..(387): a, c, t, g, unknown or other
  modified_base (400)..(400): a, c, t, g, unknown or other
  modified_base (411)..(411): a, c, t, g, unknown or other
  modified_base (471)..(471): a, c, t, g, unknown or other
  modified_base (491)..(502): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaaggggctggagtgggtggccaccataacaaaaagatggaagtgacacaacctatgtgaactctgtgatgggccgattcaccgtctccagagacgacgccaaagaactcactacatctgcaaatgaaacaacctgagagccgaggacacggctgtgtattactgtgtgagagatgtctgcgttgggccagggaccctggtcaccgtctcctccagcctcaccaagggcccatcggtcttcccccnggccnccctgctccagcncacctccgagngcacagcggccctgggctgccgtggcaaggactacttccgctacgagactgaggcggcgnggacgaaggcgacaagtagnnnnnnnnnnnn

SEQ ID NO: 400945 - DNA, 605 bp, Homo sapiens
  misc_feature: GZ8MTXP02ICTLR.15.28.C06.1.454.CMB.2.raw
  modified_base (200)..(200): a, c, t, g, unknown or other
  modified_base (268)..(268): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctggtcgganacagagtcaccatcacttgccgggcagtcagatatactaatggtgctggttcagcagaaacaggaaanccccaaaagtcctgatctctgccgcctctactttgacaaaggtcgggtccatcaagtcagcgcagtgatcgtgggacagaattcagtctcaccatcagcagcctgcacgtcgtagtaacgttatttacgacctaacttacttacgttacgaacctaagtctaactaaattaaactaagttaccttaggttacccggggaggggtaaacggggaaacggtaaacggggtaacggaaagttacggaaaacctaaaaccgggaacgttcggggaacggttctaacggtaacccgaaccgtaagtttcctaacggttttcctaccttaaccgtttcccccg

SEQ ID NO: 400946 - DNA, 569 bp, Homo sapiens
  misc_feature: GZ8MTXP02HALON.15.28.C06.1.454.CMB.2.raw
  modified_base (430)..(430): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccgggcagtcagagtatactaaatggtgcctgttcagcagaaacaggaaacgaccccaaaagtcctagatctctcgccgcctctactttgacgaaaggtcgggtacccatacgaaggtcgagccggcagtggatcgtgggacagaattcagtctacacatcagcagcctgcagcctagacgtatttcgacctaacttactactgacctaagtnactaaataaataatacgtacgtttacggggacggtaacgggaaccgtaaagggtacggaagtacgtaaacgaaaacggtaactgggtacggtactaggaaccaacctagttccttacgttctttacctaactttccccg

SEQ ID NO: 400947 - DNA, 578 bp, Homo sapiens
  misc_feature: GZ8MTXP02F74BB.15.28.C06.1.454.CMB.2.raw
  modified_base (470)..(470): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgcaggctccgaggggaaggggctggagtgggtggccaccatacaaaagatggaagtgacacaacctatgtgactctgtgatggggccattcaccgtctcctcagccctccacccacgggcccagtccgggtccttcccccgtggcccgccctcgcctccagggacnccaccctcgagacgcacgacgtccggcccgtggggcctcggccgtacggtccgaaacgggtaccttaaccgtccgactaacggtacgacgttcggacggtcggggccg

SEQ ID NO: 400948 - DNA, 540 bp, Homo sapiens
  misc_feature: GZ8MTXP02H6JF2.15.28.C06.1.454.CMB.2.raw
  modified_base (350)..(350): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccggcagtcagagtattactaatggttggcctggttcagcagaaaccagggaaacgccccaaaagtcctgatctctgccgcctctactttgactaaagtcggggtccatcaaggtcagcgcagtgatctgggacngaattcagtctcaccatcagcagcctgcagtcctgtacgtatttcgactaactttactactcgacctaaagtcacataaactaatcagtttcggagggtacgggaaccgtaagggtacggaagtaactacgaaaacggtaacgtggacgggtctaggccgaaccatctaggttccttactaactttcccg

SEQ ID NO: 400949 - DNA, 560 bp, Homo sapiens
  misc_feature: GZ8MTXP02HZ3Y3.15.28.C06.1.454.CMB.2.raw
  modified_base (279)..(279): a, c, t, g, unknown or other
  modified_base (352)..(352): a, c, t, g, unknown or other
tcagtctacgtagccacgaccggtgctcgatttagagctcacgtattgggtttggggggagtcagactcagtcaggacacagcatggacatgagggtccccgctcagcccctggggctcctgctgctctggctcccaggtgccaaatgtgacatccagatgacccagtctccgtccaccctgtctgcatctgtcggagacagagtcaccatcacttgccgggcagtcagagtattaactaaatggttggcctggtttcagcaagaaaccgagggaaacnccccaaaagtcctagatctctgccgcctctactttgacaaaggtcgggtccatcgaagttcagcgcagtggancgtgggacagattcaatctccacatcagcagcctgacagcctagacgtattttgaccttacttactactgactaagtgactaattaataactctacgtttacggacgggtaacggaacgtaaagggtggaacgacgttacgaaaacgtacgtaggtacgtcgtacgccaactacgttactacgttccttactacttacccgttccccg

SEQ ID NO: 400950 - DNA, 544 bp, Homo sapiens
  misc_feature: GZ8MTXP02F5CT4.15.28.C06.1.454.CMB.2.raw
  modified_base (273)..(273): a, c, t, g, unknown or other
  modified_base (418)..(418): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaacagggaaanccccaaaagtcctgatctctgccgctctactttgcaaagtcggggtcccatcaaggttcagccgcagtgatcgtgggacagatcagtctcacatcagcagcctgcagcctgacgtattttgactaactttactactgaccaagtnactaataaataatctagtttcgggacggagggtaaccgaagggtcggaagaattacgaaaacggtacgtggtacggcttacggaacctaaccgtacttaccgtagttaccttacgtactttccccg

SEQ ID NO: 400951 - DNA, 615 bp, Homo sapiens
  misc_feature: GZ8MTXP02HUS2W.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttgccgggccagtcagagtatactaatggtgctgttcagcagaacaggaacacccaaagtcctgatctctcgccgcctctactttgactaaaggtcgggtccagtcgaaggttcagccggcagtggatcgtgggaacngtaacttcagtcctacacccatccagacacggtccctgccgacgtcctaggaacgttagttttacgaccttaaacgtttactacgttacgaccgtaaagtcgaactaattaaactaattaccgttaagtttccggggaacgggaacggggtaaacccgtaagggggttacggaaacgtaacgtaaaccgaaaacggtaaaccgttgggtacggtactcgggaaccctacgtacttacgtacgttccttacgtacctttccccg

SEQ ID NO: 400952 - DNA, 560 bp, Homo sapiens
  misc_feature: GZ8MTXP02HM1L8.15.28.C06.1.454.CMB.2.raw
  modified_base (355)..(355): a, c, t, g, unknown or other
  modified_base (426)..(426): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagccggcagtggatgtggacngaattcagtctcaccatcagcagccctgcagcctgacgtatttagctaactttactactgacctaaaggtnacaattaaataacgtactagtttacgggacggtaggggaacccgaaaggggttacggaaggtacgttaacgaaaacggaaactggtacggcgtacggaacctaccacgttcgtcttaccttactactttccccg

SEQ ID NO: 400953 - DNA, 567 bp, Homo sapiens
  misc_feature: GZ8MTXP02ISD49.15.28.C06.1.454.CMB.2.raw
  modified_base (432)..(432): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaacgaccccaaaagtcctagatctctcgccgcctctactttgacaaaaggtcggggtacccatcaggtcagccggcagtgatctagggacagattcagtctcacatcagcagcctgcagcctgacgtattttcgactaaactttactaacttcgacctaagtnacaattaaactattactaagtttcgggacgggaacgggaaccgtaaaagggttcggaacgattaccgaaaaaccgtacgtgtacggtcctaggaacaaacccgtattaccgttacgttaccttactacgttcccg

SEQ ID NO: 400954 - DNA, 551 bp, Homo sapiens
  misc_feature: GZ8MTXP02IWNKA.15.28.C06.1.454.CMB.2.raw
  modified_base (359)..(359): a, c, t, g, unknown or other
tcagtctacgtagccacgaccggtgctcgatttagagctcacgtattgggtttggggggagtcagattcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagaccccaaaagtcctgatctctgccgcctctactttgacaaagtggggtcccatcaaggttcagccggcagtggatcgtggggacnggaattcagtctcaccatcagcagcctgcagccctgacgtatttcgactaaacttactaacttgaccctaaggtcacaattaaataatctaagtttccgggagggtaagggaaccaaaggggttaggaagaataaccgaaaacgaacgtggtacggctagaaccgactaactctagtccttcaactttcccc

SEQ ID NO: 400955 - DNA, 539 bp, Homo sapiens
  misc_feature: GZ8MTXP02GCL88.15.28.C06.1.454.CMB.2.raw
  modified_base (423)..(423): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaagccccaaaagtcctgatctctgccgcctctactttgacaaagtggggtcccatcaaggttcagccggcagtggatcgtgggacagaattcagtctcaccatcagcagcctgcagcctgacgtattttgacaacttactaactgaccaagtnactaataatatactacgttacggacggaaggacgtaaggtacgagaactaacgaaacgtaacgtaggtacgacgtacgaacctaccgtacttcgttacgttaccttactacttccg

SEQ ID NO: 400956 - DNA, 567 bp, Homo sapiens
  misc_feature: GZ8MTXP02G2USC.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggtgctggttcagcagaaccaggaaacgaccccaaaagtcctagatctctcgccgcctctactttgacaaaggtcggggtcccatacgaaggtcaggccggcagtggatcgtgggacagtaattcagtctacacatcagcagcctgcacgcctagacttatttcgacttaaacttactactcgacctaagtcactaataaataactcgtaagtttccggggacgggaacgggtaacgaaggggttacggaacgtaataacggaaaacgtaacgtaggttacggccttaggaaccactacgttctacgtttccttactactttcccg

SEQ ID NO: 400957 - DNA, 626 bp, Homo sapiens
  misc_feature: GZ8MTXP02GSQQD.15.28.C06.1.454.CMB.2.raw
  modified_base (359)..(359): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagagtattactaatggttgctggttcagcagaaacaggaaacgaccccaaaagtcctgatctctgcccgtcctctactttgactaaaggtcggggtcccatcgaaggttcagccggcagtggatcgtgggacngacttcagtctcgacctatcagcagcctgcagcctagacgtatttcgactaacttactactacgacctaaggtctaacctaattaaacgttaacttaccgttaaggtttaccgggggacggggtaaacgggggtaaaccgtaaagggggttacgggaaaacgtaacgtaaaccggtaaaaacggtaaaccggttggtacgggtaccttacggaaccctaacccgtaattcccgttacggtttccctttaccgtaaccttttcccccg

SEQ ID NO: 400958 - DNA, 526 bp, Homo sapiens
  misc_feature: GZ8MTXP02JOXYM.15.28.C06.1.454.CMB.2.raw
  modified_base (429)..(429): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggttggcctggttcagcagaaacaggaaacgaccccaaaagtccagatctctcgccgcctctactttgacaaaggtcgggtccatcaaggtcagccggcagtggatcgtgggacaggtaattcgagtctacaccatcagcagcctgcagcctgacgttatttgactaacttactactggacctagtnactaataactaatctagttcggacggagggtacaagggtggagataacgaaacgtacgtggtcggctacgctacctatctgttcctcacgtttcccg

SEQ ID NO: 400959 - DNA, 639 bp, Homo sapiens
  misc_feature: GZ8MTXP02GLPKQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggtgctggttcagcagaaacgaggaaacaccccaaaagtcctagatctctcgccgtcctctactttgactaaaggtcggggtacccagtcgaaggttcaggccggcagtggatcgtagggacagaacttcagtctacacatcagcacgcctgcacgtcctagacgttattttcgaccttaaactttacctactcgaccgtaagtcgtactaaattaaactaaacttacgtaacggttttccggggaaccggggttaacgggggaaaccgtaaagggggttacgggaaaacggtaacgtaaacggtaaaaaccggtacggttagggttacgggaccttacgggaaccctaaaaccgttacgtttccgttacggtttacctttccgtaaccttttcccccgg

SEQ ID NO: 400960 - DNA, 606 bp, Homo sapiens
  misc_feature: GZ8MTXP02GBR3Q.15.28.C06.1.454.CMB.2.raw
  modified_base (366)..(366): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccgagggaaacgaccccaaaagtcctagatctctcgcccgcctctactttgcgaaaggtcggggtccatcgaaggttcaggccggcagtggatcgtgggacngtaattcagtcctacacatcagcacgccctgcaacgtcctaggacgttacgttttgacctaaacctttactaactcggaacctaggtacactaataaactaattcgtaacgtttcggggacggggaacgggtaaccgtaaggggtagggtaacgaataaccggtaaaacgtaacggttgtacgggactacggaacctaacccgtaagttcccgttaggtacctttactaccgtttccccg

SEQ ID NO: 400961 - DNA, 537 bp, Homo sapiens
  misc_feature: GZ8MTXP02GP15R.15.28.C06.1.454.CMB.2.raw
  modified_base (406)..(406): a, c, t, g, unknown or other
  modified_base (424)..(424): a, c, t, g, unknown or other
  modified_base (432)..(432): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggtgctggtcagcagaacaggaacacccaaaagtcctgatctctcgccgcctctactttcgacgaaaggtcggggtacccatacgaaggttcaggccggcgaggtggatcggtaggaactagaacttcagtcctacaccatcagcacgctgcacgcctgaacgtntttcactaacttactacngacctagnacaataaatagtctagttcggacggtaagggacaaggtcgaatactaacaaaacggtactggtacgcgtacgaaccgtaaccattctgttacctctactttcccg

SEQ ID NO: 400962 - DNA, 617 bp, Homo sapiens
  misc_feature: GZ8MTXP02HH5Y1.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagatcaccatcacttgccgggcagtcagagtattactaaatggttgcctggttcagcagaacaggaaacgacccaaaagtcctagatctctcgccgcctctactttgacgtaaaacggtcggggtaccctagtacgtaaggttcgaaggcccggacgaggtcggatcgtaggggacaggtaaacttcaacgttcctacctaacctataccgaagccaacggccctggaccaacgtcccctaggaaccgttattttcgaccttaaacctttactaacgttgaccctaaggtctactaaattaaagttaactctaagtttcgggacggtaaggggacctaaagggtcgaacgtactaacgaaacgtaacgtggtacgcgtacgaactacccgattcgtcgttacttacctactttccccg

SEQ ID NO: 400963 - DNA, 606 bp, Homo sapiens
  misc_feature: GZ8MTXP02I3XIE.15.28.C06.1.454.CMB.2.raw
  modified_base (365)..(365): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgccccaaaagtcctagatactctcgccgcctctactttgcaaaagtcggggtacccatacaaggttcagccggcagtggatcgtagggacnggaatcagtctcacatcagcagcctgcagccctgaacgtattttcgactaaacttactactacggaccctaaggtcactaaataaacttaattactaacgtttacggggacggttaaacggggaaccgtaaaggggttaggaaacgtaacgtaaacgaaaaaccgtaacgttaggtaacggcgttaggaaccgtaacccgtaacgttacttcggttacctttaccgtaacgtttccccccg

SEQ ID NO: 400964 - DNA, 608 bp, Homo sapiens
  misc_feature: GZ8MTXP02GI3RO.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccccgtctgcatctgtcggagacagagtcaccatcacttgccgggccagtcagagtattactaaatggttggcctggttcagcaagaaacaggaacacccaaagtcctgatctctcgcccgcctctactttgacgtaaaggtcggggtacccatacgaagttcaggcggccagtgatcgtgggacagtatcagtctacaccatcagcacgcctgcacgcctagaccgtattttcgactaacttactactacgacctaagtgactaattaaactaactcgtaacgtttccggggacgggtaacggggaaccgtaaaggggttagggaagtaacgtaaaccggaaaacgtaaacggtggtacggtaccgtacggaccctaaaccgtacttaccgttcgttacctttaccgtaactttccccgtttaacccccg

SEQ ID NO: 400965 - DNA, 577 bp, Homo sapiens
  misc_feature: GZ8MTXP02FO67H.15.28.C06.1.454.CMB.2.raw
  modified_base (289)..(289): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaacaggaaacgccccaaaagtcctagatcnctgccgcctctactttgctaaagtcggggtaccatcaaggttcaggccggcagtggatcgtagggacagaattcagtctcacatcagcacgcctgcagcctgacgtattttgactaacttactactacgacctaaagtcaactaattaaactaacttacgtagtttacgggacgggtaacgggaaccgtaaaggggtacggaaagtaactaaccgaaaacggaaacgttggtacggcgttacggaaccgtaactaacgttccttacgttactttacgtactttccccg

SEQ ID NO: 400966 - DNA, 574 bp, Homo sapiens
  misc_feature: GZ8MTXP02II2FU.15.28.C06.1.454.CMB.2.raw
  modified_base (406)..(406): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttgccgggcagtcagatattactaatggttgctgttcagcagaacaggaaacgaccccaaaagtccagatctctcgccgcctctactttgacaaaggtcggggtccatcgaaggttcagccggcagtggatcgtagggaacaggtaattcacgttacctacaccatacacgcacgcctgcacgctgacgtntttacgactaacttaactactcgacctaagtgactaataaactattactacgtttacgggacgggtaacgggaaccggtaaagggtacggaagtaacgtaacgtaaaaccgaaacgtggtacgggtactaggaacctacgtacttctagtttccttactactttcccg

SEQ ID NO: 400967 - DNA, 566 bp, Homo sapiens
  misc_feature: GZ8MTXP02HEYXK.15.28.C06.1.454.CMB.2.raw
  modified_base (249)..(249): a, c, t, g, unknown or other
  modified_base (376)..(376): a, c, t, g, unknown or other
  modified_base (437)..(437): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcacatcacttgccggcagtcagagtatactaatggtgctggttnagcagaacaggaacgacccaaagtctagatctctcgccgcctcttacttgacgtaaaggtcggggtaccacgtacgtaacggttcaggccggacgaggtggatcgtagggacagtaattacagttcncacatcagcagcctgcagtccgtagtacgtatttcgacttaacttactactcgacctagtnactaataaactaatctagttcgggacggaagggaccgaaagggtacggaagtaacgtaaacgaaaccgtaacgtggtacgcgtacgaacctaaccgtacttccgttacgtacctttacacgtttccccg

SEQ ID NO: 400968 - DNA, 594 bp, Homo sapiens
  misc_feature: GZ8MTXP02I484U.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggtgctggttcagcagaaacaggaaacgaccccaaaagtcctagatctctcgcccgccttctactttaggtaaaaggtcggggtccctatcaaaggttcaaggcgccagtgatcgtaggacaggtacttcgacgttccaccactacacgacacgtacgccgagacgaccgtccgtagtacgttagtttacaactaacttactacgtacgaacgtagtactaactaaattaaactacgtacgttacggttacgggaacggtaacggaacgtagggagtaacgaacgtaaacgaaacgtaacgtggtacgtacgacgacctaacgtacgttcgtacttctacgtccttccgtacccg

SEQ ID NO: 400969 - DNA, 557 bp, Homo sapiens
  misc_feature: GZ8MTXP02IT4UV.15.28.C06.1.454.CMB.2.raw
  modified_base (357)..(357): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagaccccaaaagtcctgatctctgccgcctctactttgcaaaggtcggggtccatcaaggttcagccggcagtggatctgggacngaattcagtctcacatcagcagcctgcagctagacgtattttcgactaacttactacttcgacctaagtcgacaataaataatactagtttacgggacggtaaggggaccgaaggggtacggagaaagttacgaaaaacggtacgtaggtacggcgttacggaacgtaaccacttcgtgttacctttctaactttccccg

SEQ ID NO: 400970 - DNA, 538 bp, Homo sapiens
  misc_feature: GZ8MTXP02GD4B6.15.28.C06.1.454.CMB.2.raw
  modified_base (364)..(364): a, c, t, g, unknown or other
  modified_base (472)..(472): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaaagccccaaaaagtcctgatctctgccgctctactttgcaaaagtggggtccatcaaggttcagccgcagtgatctgggacagaatcagtcncacatcagcagccctgcagccctgaacgtattttgactaaacttactactcgacctaagtcacaataaataagtactaagtttcggcggaaacggggacctaaagggnggaagaatacgaaaacgaaacgtgtacggctacggaacaccctaatctatccttcaactttccccg

SEQ ID NO: 400971 - DNA, 547 bp, Homo sapiens
  misc_feature: GZ8MTXP02FNC1Y.15.28.C06.1.454.CMB.2.raw
  modified_base (359)..(359): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggttggctggttcagcagaacaggaaacgaccccaaaagtcctgatctctcgccgcctctactttgcaaaaggtcggggtcccatcaaggttcaggccggcagtggatcgtggggacnggaattcagtcctcacatcagcagcctgcagcctgacgtatttgactaacttactactgaccaagtgactaataataatctaagtttcggggacggaacggggaccgaaagggtcggaagtacgtaaacgaaaacgaacgtaggtacggctaggccgtaaccacgttctagttcttacactttccccg

SEQ ID NO: 400972 - DNA, 583 bp, Homo sapiens
  misc_feature: GZ8MTXP02FXHBR.15.28.C06.1.454.CMB.2.raw
  modified_base (355)..(355): a, c, t, g, unknown or other
  modified_base (365)..(365): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggttgctggttcagcagaacaggaacacccaaaagtcctagatctctgccgcctctactttgactaaaggtcggggtcccatcgaaggttcaggccggcagtggatcgtgggacngaatcagtcncacatcagcagcctgcagcctgacgtatttgactaactttactactcgacctaaagtcgaactaattaaaactaactcgtaacgtttcggggacgggtaaaggggaacccgtaaaggggtacggaaggtaacttaaccgaaaaacggtacgttaggtacgggtacttaggaaccgtaaccctaagttccgttggttaccttaccgtacgtttcccccg

SEQ ID NO: 400973 - DNA, 575 bp, Homo sapiens
  misc_feature: GZ8MTXP02J3CEB.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccgggcagtcagagtattactaaatggtgctggttcagcagaacaggaacacccaaagtctgatctctcgccgtctctacttgactaaaggtcggggtcccagtcgtaaggtcaggcccggcgagtcggtatcgtgggaacagaattcagtctacacctatcacgcacgtccctgctagcgtagacgtatttacgacctaacttactactcgaccgtaagtacgactaaattaaactaacgttacgtaacggtttaccggggaaccgggtacggggtaaaccgaagggtacggaaagtaacgtaacgaaaacgtacgtagacggctagcctaactactcttcgtctactacttcccg

SEQ ID NO: 400974 - DNA, 519 bp, Homo sapiens
  misc_feature: GZ8MTXP02GNRA7.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgatctctgccgcctctactttgactaaagtggggtcccatcaaggtcagccgcagtggatcgtggacagatcagtctcacatcagcagcctgcacgcctgacgtattttagctaaacttactactagccaagtgacataaataatactagtttcgggacggagggtaccaagggtgaagatacgaaaagactggtacgctcgaactaccattctcggtacttcactttcccg

SEQ ID NO: 400975 - DNA, 546 bp, Homo sapiens
  misc_feature: GZ8MTXP02I8EVE.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacagggaaacgaccccaaaagtcctgatctctcgccgcctctactttgactaaaggtcggggtacccatcgtaaggtcagccggcagtgatcgtgggacagaattcagtctcacatcagcagcctgcagcctgacgtatttcgactaacttactactcgacctaagtcactaattaaataatactagtttcgggacggaaggggaccgaagggtacggaagagtaacgaaaacgtaacgtggtacggtctaggaaccacctactctacgtcttcactttcccg

SEQ ID NO: 400976 - DNA, 598 bp, Homo sapiens
  misc_feature: GZ8MTXP02ISQFO.15.28.C06.1.454.CMB.2.raw
  modified_base (288)..(288): a, c, t, g, unknown or other
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaccaggaaagccccaaaagtcctgatcnctcgccgcctctactttgctaaagtggggtcccatcaaggttcagtcggcagtcgatcgtgggacngaattcagtctcacatcagcagctgcagctgtacgtatttcgactaacttactacttcggacctaagtcgacaattaaataacttctaacgtttacggggacgggttaacggggaacccgtaaaggggttacgggaaaggtaacttaaaccgaaaaaccggtaacgttcggtaacgggtcctttacggaaccgtaaaacccgaggtttacttacggtttccctttacgtaaccttttcccccgg

SEQ ID NO: 400977 - DNA, 582 bp, Homo sapiens
  misc_feature: GZ8MTXP02I6S2Z.15.28.C06.1.454.CMB.2.raw
  modified_base (403)..(403): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccgaggaagaccccaaaagtcctagatctctgccgcctctactttgctaaaggtcggggtacccatcgaaggttcagccggcagtggatcgtagggacagaaattcagttctacaccatcagctagccctggcagccgnacgtacgtttagttactaacttaacttactacgacgtaacgagactaataaactaaattaacttaacgttacggacgggtaacgggtaacggaagggtacggaaaggtagtaacgaaaacgtaacgtacggtacgtacgtacgaaccgacgtactacgtacgttccttactacttcccg

SEQ ID NO: 400978 - DNA, 550 bp, Homo sapiens
  misc_feature: GZ8MTXP02J444T.15.28.C06.1.454.CMB.2.raw
  modified_base (368)..(368): a, c, t, g, unknown or other
  modified_base (443)..(443): a, c, t, g, unknown or other
  modified_base (525)..(525): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgaccccagtctcccgtccaccctgtctgcatctgtcggagacagatcaccatcacttgccgggccagtcagtatattactaattggtgcctggttcagacacgaaaccacggaaacgccccaaaagtcctgatctctcgccgccctctactttagcaaaacggtcggggtccactacaaggttcagccggcagtcggatcgtaggacngtaaattcacgtctcaccagtcagcagcctgcagcctgtacgtattttgactaacttactacttcgcaacgttanactataataatacgtacgttacgggtacgggacggggacgaaacggtaggagaacgtaacgtaaacgaacgtacgtcgctcncgactactctcttctttcttactcc

SEQ ID NO: 400979 - DNA, 673 bp, Homo sapiens
  misc_feature: GZ8MTXP02JPNH2.15.28.C06.1.454.CMB.2.raw
  modified_base (424)..(424): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagtagtattactaagtggttggcctggtttcagcaagaaaccgaagggaaacgaccccgaaaagtcctagatctctcgccgcctctactttcgacgaaaggtcggggtacccagtcgaaggttcaggccggcaggtggatcgtgggacagtaattcagtctacacatcagcacgccctgcgagtccctcggaacgttnttttacgaccttaaactttacctacgtacgacctaaggtctacctaaattaaaacttaactacgttaacggttttaccgggggaacggggtaacgggggtaacccgtaaaagggggtacggggaaacgtaaaccggttaacgaaaaacccgggtaaacggttcgggtaaccggggtacctacggtaacccgtaccctaaacggtttaccttacggtttcccttttaccggacccgtttttaaccccccg

SEQ ID NO: 400980 - DNA, 534 bp, Homo sapiens
  misc_feature: GZ8MTXP02JDIVU.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgacaaagtggggtcccatcaaggttcagccggcagtgatcgtggacagatcagtctcacatcagcagcctgcagcctgacgtattttcgactaacttactacttgacctaaagtcgacaattaataattactagtttccggacgggtaagggtaccgaaggtaggacgaataccgaaaacggactgtacggactgaaccgacctagtctagtcttctacgttccc

SEQ ID NO: 400981 - DNA, 681 bp, Homo sapiens
  misc_feature: GZ8MTXP02IY6DS.15.28.C06.1.454.CMB.2.raw
  modified_base (266)..(266): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagacgtcaccatccacgttcggccgggccagtcagagttattaactaagtggtgcctgttcagnacgaacgaggaacgacccaaagtcctagatctctcgccgcctcttacttgacgtaaacggtcggggtaccctagtacgtaaggttcgaggcccggctaggtggacgtgtagggaactagtaacttcacgttctaccactatccgaagtccacgtccgtacgaccacgtaccgtcgtaacgtttatttacgaaccttaaaccgttttaacaacgttaccggtaacccgttaaagtaccgttaactaaaattaaacttaaccgtaacgttacgggtttaccgggggaacgggtaaccgggtaaaaccggtaagggttaccgggaaagtaaacgtaaacggaaaaccggtacgtggtacggtacctacggaacctaaccctagttccgtacgtttccttaacccgtactttcccccgg

SEQ ID NO: 400982 - DNA, 586 bp, Homo sapiens
  misc_feature: GZ8MTXP02GZEAG.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgctggttcagcagaaccaggaaacgaccccaaaagtcctgatctctcgccgcctctactttgactaaaggtcggggtccatacgaaggtcagccggacagtggatcgtagggacaggaattcagtctcaccatcagcagcctgcacgctgacgtatttagactaaacttactacttacgaccaaagttcactaaataaactaatactagtttacgggacggaaagggaccgaaaggtcgggaagtacgtaaacgaaaaccggtaaacgtgggttacggacgttacggaaccgtaacccgtaagttccgttacgtttcctttaccgtaacgtttttccccccg

SEQ ID NO: 400983 - DNA, 525 bp, Homo sapiens
  misc_feature: GZ8MTXP02GJT2P.15.28.C06.1.454.CMB.2.raw
  modified_base (359)..(359): a, c, t, g, unknown or other
  modified_base (512)..(512): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctagatctctgccgcctctactttgacaaaagtgggtcccatcaaggttcagccgcagtggatcgtgggacngaatcagtctcacatcagcagcctgcagcctgacgtatttgactaacttactactgacccaaagtcacaataaactaatactaagtttcggacgggaagggacccaaagggtcggaaggatacaaaacgaactgtacggctagcaccatcctntctacacttcccg

SEQ ID NO: 400984 - DNA, 775 bp, Homo sapiens
  misc_feature: GZ8MTXP02JAKTF.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcactcgtcggtacggacgacgaggtacgtaccaacctactacctacgttccgggccccggacctacgtacgaagtaagttaactttaaacgtaaggttcgggttcggtccgtttaggttacgacgacgaaaccgaaacggaaacgggaaacccaaccccgtaaacgtccgtagtacttcctcgtaccggtccctcctttaccttacgttcgaacgtaacggggtccggtacctagtacgtacggtcgacggcccgacgtaggtagtacgtcggtacgggaactagtactacggtactcctaccaactacgtacgacgccgaaccgtcccgtacgacgtacccgtccgtaaggtacgttttacgtttacgaaacccttaaaccgtttacctaccggttacaacccgttaaggtaccgtaactaaaacgttaaacttacgtacggtttaacgggttaccgggggaaacgggaaacgggtacgtaaaggggtacgaaacgtaaccgtaaaccggaaaacggttagttcggggacgtaccgtaccgaacctaaacgttcgttccggttacttaccttacctaacgtttccccg

SEQ ID NO: 400985 - DNA, 566 bp, Homo sapiens
  misc_feature: GZ8MTXP02GDTCN.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctactgctgctctggctcccaggtgccaaatgtgacatccagatgacccagtctccgtccaccctgtctgcatctgtcggagacagagtcaccatcacttgccgggcagtcagagtattactaatggtgctgttcagcagaacaggaacaccccaaaagtcctagatctcgtcgcccgccttctactttgactaaaggtcggggtccatcgaaggttcaggccggcgagtggatcgtagggacagtaattcagtcctacacatcagcacgcctgcacgtctgaacgttatttcgacttaacgttacctactcgacctaagtgaactaataaatactcgtaagttcgggacgggtaaggaaccgtaagggtacggaagaagtaaccgaaaacggtactaggtacggtctacggaacctaaccgtcgttactcgttccttactactttccccg

SEQ ID NO: 400986 - DNA, 533 bp, Homo sapiens
  misc_feature: GZ8MTXP02IYFAQ.15.28.C06.1.454.CMB.2.raw
  modified_base (348)..(348): a, c, t, g, unknown or other
  modified_base (353)..(353): a, c, t, g, unknown or other
  modified_base (387)..(387): a, c, t, g, unknown or other
  modified_base (511)..(511): a, c, t, g, unknown or other
  modified_base (520)..(520): a, c, t, g, unknown or other
tcagtctacgtagccacgaccggtgctcgatttagagctcacgtattggggtttggggggagacagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttgctggttcagcagaacaggaaacgaccccaaaagtcctgatctctgccgcctctacttgacgaaaggtggggtcccatcaaggtcagccggcagtgatcgnggacngtaacttcagtcctacactatcgagcagcctgcngcctgacgttatttcgactaacgttactacttgaccgtaagtcactaataaattactactagtttaccgggacggtaggaccgaagggtggaataagtacgaaaacgtagtcgacggctgaacncctatcgtntcttcactttccg

SEQ ID NO: 400987 - DNA, 566 bp, Homo sapiens
  misc_feature: GZ8MTXP02I82PQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagaccccaaaagtcctgatctctgccgcctctactttgcaaagtggggtcccatcaaggttcagccggcagtgatctgggacagattcagtctcaccatcagcagccctgcagcctgacgtattttgactaactttacctacttgaccctaagttcgactaaattaaataaacttactagttttacgggacggggtaacgggaaccgtaaaggggttagggaagaaacttacgaaaaacggaaacgttgtacgggctaggaacctaccagttcctgttccttactactttccccg

SEQ ID NO: 400988 - DNA, 748 bp, Homo sapiens
  misc_feature: GZ8MTXP02HL2JF.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtcccaccctgtctgcatctgtcggagacagacgtcaccatcacgttcggccggcagtcagtagtattactaagtggtgctgttcagacaacgaacgaaggaaacaccccgaaagtcctagactctccgtcgccgtccttacttacgtttcgaacgtaaagggttccgggtaccctagtacgtaacggttccgaggcccggacgtaggtggtacgtcggtaggggaactaggtaaacttacgacgtacctaccaactactacgacgacaccgtccgtacgaccctaacggtcccgttaggtaaccgtttacggttttaaccgaacctttaaaccgtttaaaccttaaccgtaccgtaaacccggttaaagttacgaaaaccgttaaattaaaacttaacgttaaccggttaacgggtttaacgggggaaccgggaacggggtaaaaccgtaaggggttaaggaaacgtaaacggtaaaccggtaaaaccgttcggtacggggtactaaccggtacgaacccgtaaaccgtacgtttcccgtacgtttacccgttccgttaacccgtttacccccg

SEQ ID NO: 400989 - DNA, 495 bp, Homo sapiens
  misc_feature: GZ8MTXP02HOXJ9.15.28.C06.1.454.CMB.2.raw
  modified_base (414)..(414): a, c, t, g, unknown or other
  modified_base (453)..(453): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggttgctggttcagcagaaacaggaaacaccccaaaagtcctgatctctgccgcctctactttgcaaagtcggggtccatcaagtcagccggcagtggatgtggacagaatcagtctcaccatcagcagctgcagcctaggactatttcgactaacttactactgacctaagtnacataataatcaagttcggacggagggacaggtgagtanaacaaacgaactgacggctacgcacatctgtctctacttccc

SEQ ID NO: 400990 - DNA, 586 bp, Homo sapiens
  misc_feature: GZ8MTXP02G56I2.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaagccccaaaagtcctgatctctgccgcctctactttgcaaaggtggggtcccatcaaggtcagccggcagtggatcgtgggacagaatcagtctcacatcagcagctgcagcctgacgtatttgactaacttacacttggacctaagtgactaattaaataattaccgtagtttcggggacggtaaacgggggaacctaaaggggttacgggaaggaacttaaccggaaaaacgtaaaccgttacgggttagggcgttacggaaccgtaacccgaagtttaccttacggttacccttttcaaccgttttcccccg

SEQ ID NO: 400991 - DNA, 514 bp, Homo sapiens
  misc_feature: GZ8MTXP02JB5DO.15.28.C06.1.454.CMB.2.raw
tcagtctacgtagccacgaccggtgctcgatttagagctcacgtattgggtttgggggagtcagactcagtcaggacacaacatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaagttcagcggcagtgatctgggacagattcagtctcaccatcagcagcctgcagcctgacgtattttgactaacttactactgccaagtgactataaataatcaatttcgggacggtagggaccgaagggtcggaagactacaaaacgaaactggtgctgacaacatctcgtcttcactcttcccg

SEQ ID NO: 400992 - DNA, 543 bp, Homo sapiens
  misc_feature: GZ8MTXP02HQKL4.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagatatactaaatggtgctgttcagcagaaccaggaacacccaaaagtcctgatctctcgccgcctctactttgacaaaggtcggggtcccatcaaggttcaggccggcagtgatgtggggacagaattcagtctcaccatcagcagcctgcagcctgacgtatttcgactaacttactactgacctaagtgactaataaataatctaagtttcgggacgggagggaaccgaagggtggaagataaacgaaaacggtaaacgttggtacggtctacggaaccgacctaatcctagttactttactactttaccccg

SEQ ID NO: 400993 - DNA, 523 bp, Homo sapiens
  misc_feature: GZ8MTXP02FKVC0.15.28.C06.1.454.CMB.2.raw
  modified_base (360)..(360): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaagggaaacgaccccaaaagtcctgatctctgccgcctctactttgacaaagtggggtccatcaaggttcagccggcagtggatcgtgggacngaattcagtctcacatcagcagcctgcagcctagacgtattttcgactaacttactactgacccaaagtgactaataaactaatactaagtttcgggacggtaagggaccgaaaggtggagatacaaacgaactgtggctgcacactctgtctacacttcccg

SEQ ID NO: 400994 - DNA, 619 bp, Homo sapiens
  misc_feature: GZ8MTXP02H1I6B.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaccagggaaacgaccccaaaagtcctgatctactgccgcctctactttgacgtaaagtcggggtacccagtcgtaaggttcagccggacaggtggactcgtaggggacaggtaactttcacgtcctacactatacacgcaacgccctggaccagtacccgtagtaccgttattttcgaccttaaacttacctactacgacctaaaggtcactaattaaactatcttaacgttacgggacggtaacgggaccgtaagggttaggaagtaacttaacgaaaaccggtaacgttggtacggtacgtacggtaaccaacccggtaattccgttacgtacctttactaacgtttcccccg

SEQ ID NO: 400995 - DNA, 539 bp, Homo sapiens
  misc_feature: GZ8MTXP02HP5QQ.15.28.C06.1.454.CMB.2.raw
  modified_base (434)..(434): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtgctggttcagcagaacaggaaacaccccaaaagtcctagatctctcgccgcctctactttgactaaaggtcggggtcccatcgaaggttcagccggcagtggatcgtagggacaggtaaattcagtcctacaccatcagcagcctgcagcctgacgtatttcgactaacttactactcgacctaaagtnacaataaatagtactagtttcgggacggagggaccaagggtggaacgtataacgaaaacgaacgtggtcgacgtagaacgactatcgtacgtctactacttcccg

SEQ ID NO: 400996 - DNA, 648 bp, Homo sapiens
  misc_feature: GZ8MTXP02IJ5C8.15.28.C06.1.454.CMB.2.raw
  modified_base (198)..(198): a, c, t, g, unknown or other
  modified_base (253)..(253): a, c, t, g, unknown or other
  modified_base (256)..(256): a, c, t, g, unknown or other
  modified_base (628)..(628): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcaggtatataatagtggtcgcgttgtanganaacgaacggaaggaacccgaaccgaacgtcgagtactctcgtccgcccgtccttaccttagttacgaacgtaacggggttccggtacctagtaacgtacggtacgacggtccgacgtaggtacgtacgttcgggtacggaactaggttacttacgtacgtccctaccgaacgtactacgacgacgaccgtcgcgacaccgtcgtacgtagtttacgtcgaacttaaccttactaccgacgtaacgtagtacctaataaattaaactacgtacgtttacgggtacgggacgggtaaacggaacgggtagggtaacgaactaacgtaaaccgaaaacggtcgttgggaccgtctacgaacctactacggttctnttaccttacgactttccccg

SEQ ID NO: 400997 - DNA, 604 bp, Homo sapiens
  misc_feature: GZ8MTXP02JBIPX.15.28.C06.1.454.CMB.2.raw
  modified_base (357)..(357): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaagtggggtcccatcaaggttcagccggcagtggatcgtgggacnggaattcagtctcaccatcagcagcctgcagcctgactatttgactaacttactactgaccctaagtcgactaataaataactctaacgtttcgggacgggtaaggggtaaccgtaaaggggttggaaaacggtacgtaaccgtaaaaaccggaacgtttacgggtacgggaccgtttaacgggaaccctaaacccgtaacgtttccgttacggtttaccccttttacgtaaactttttccccccgg

SEQ ID NO: 400998 - DNA, 511 bp, Homo sapiens
  misc_feature: GZ8MTXP02F6ZEW.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaaagtggggtcccatcaaggttcagccggcagtgatctgggacngaaattcaagtctcaccatcaagcagcctgcagcctgacgattttgcaacttactactgaccaagtgacaataaataattcaatttcggacggagggaccaaaggtcggaggatacgaaaacgaaactgtgctgcaccatctgtcttcacttccc

SEQ ID NO: 400999 - DNA, 516 bp, Homo sapiens
  misc_feature: GZ8MTXP02G8MM0.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggcctggttcagcagaaaccagggaaaagcccccaaaagtcctagatactctgccgcctctactttgcaaaagtggggtcccatcaaggttcagccggcagtggatctgggacaggaattcagtctcacatcagcagccctgcagcctgacgtattttgcaaacttactacttgccaagtgacataaactaatcaagtttcggacggagggtaccaaagggtgaggatacgaaacgaaactgtagctagcaccatctagtcttacattccc

SEQ ID NO: 401000 - DNA, 630 bp, Homo sapiens
  misc_feature: GZ8MTXP02IAIHX.15.28.C06.1.454.CMB.2.raw
  modified_base (247)..(247): a, c, t, g, unknown or other
  modified_base (250)..(250): a, c, t, g, unknown or other
  modified_base (261)..(261): a, c, t, g, unknown or other
  modified_base (284)..(284): a, c, t, g, unknown or other
  modified_base (382)..(382): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccacctgtctgcatctgtcggagacagagtcaccatcacttgccgggcagtcagagtatactaatggtgctgttnagnagaacaggaancccaaaagtctgatctctcgccncctctactttgactaaaagggtcggggtccatacgtaaggttcagccggcaggtggatcgtagggacaggtaatttcagttcctaccaacatcgaacncgacgtccgtacgacgacgtaccgttacgtaacgtttatttaccgaccttaaacctttaccgtaacgtaccggtaaccgtaaagtacgtaactaaattaaacgttaacgttaccgttaacgggttaccgggggaacgggtaacggggtaaacgtaagggtacggaaagtaacgaaaacgtaaaacggtacgtacggtacgtacgtacgaacctaactacgttacgttacgttaccttactacctcccg

SEQ ID NO: 401001 - DNA, 599 bp, Homo sapiens
  misc_feature: GZ8MTXP02IBA35.15.28.C06.1.454.CMB.2.raw
  modified_base (390)..(390): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccacctgtctgcatctgtcggagacagagtcaccatcacttgccgggccagtcagagtatactaatggtgctgttcagcagaaacaggaaacgacccaaaagtcctagatctctcgcccgcctctactttgactaaaggtcggggtaccatacgtaaaggttcaggtccggactaggtggatcgtaggggacagtaattcagtctacaccatcancagcctgcacgtcctagacttatttcgactaacttactactgacctaagtcacaattaaataatcgtagtttcggggacggtaaggggaaccgtaaagggtcgggaaagtaacgtaaaccgtaaaacggtacgttacggtacgggtaccttacggaaccctaaccgtaactttacccgtcggtttaccctttacctaacgtttcccccg

SEQ ID NO: 401002 - DNA, 555 bp, Homo sapiens
  misc_feature: GZ8MTXP02JZ6H6.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaaccagggaaacgccccaaaagtcctgatctctcgccgcctctactttgcaaaggtcggggtcccatcgaaggttcaggcccggcagtggatcgtggggacaggaattcagtctcacatcaagcagcctgcagcctgacgtattttgactaacttactactgaccaagtgacaataatatacgtagtttcggacggtaacgggaaccgaaggtgggaaagtagtacgaaaacgaacgtcgtacgggactacggaacctaaccgtacgtcgtacgtcttactacttcccccg

SEQ ID NO: 401003 - DNA, 586 bp, Homo sapiens
  misc_feature: GZ8MTXP02JN7Z4.15.28.C06.1.454.CMB.2.raw
  modified_base (358)..(358): a, c, t, g, unknown or other
  modified_base (365)..(365): a, c, t, g, unknown or other
  modified_base (396)..(396): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcggagtattactaagtggttgcctggttcagcagaaacagggaaacaccccaaaagtcctagactctctcgcccgcctcttactttgactaaaggttcggggtaccatcgaaggttcagcggccagtgatcgngggacanattcagtcacacctatcacgcagccctgacncgtccctgtacgtattttcgactaactttactacgtcgacaagtgactaattaaataatcgtaagtttcggggacgggtagggtaaccggaagggacggtaagacgttaaaccgaaaacggtaacgtgggtacggtacgttacggacctaaccgtacttccgtacgttccttactacgttcccttacccg

SEQ ID NO: 401004 - DNA, 520 bp, Homo sapiens
  misc_feature: GZ8MTXP02JS1Q9.15.28.C06.1.454.CMB.2.raw
  modified_base (363)..(363): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctagatctctcgccgcctctactttgacaaagtcggggtcccatcaaggttcagccggcagtggatcgtgggacngaattcagtctcacatcagcagcctgcagcctgacgtattttgactaacttactactgaccaagtgacaataataatctagtttcggacgggtagggaaccgaagggtggaagagtacaaacgacgtgtacggctgcacatctgtcttcacttcccg

SEQ ID NO: 401005 - DNA, 543 bp, Homo sapiens
  misc_feature: GZ8MTXP02IDCFP.15.28.C06.1.454.CMB.2.raw
  modified_base (198)..(198): a, c, t, g, unknown or other
  modified_base (413)..(413): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtattactaaatggtgctgttcagcagaaaccaggaaagccccaaaagtcctagatctctgccgcctctactttgctaaagtcgggtccatcgaaggtcagccggcagtgatcgtagggacagaattcagtctcacatcagcagctgcagcctagtacgattttgactaaacttactacttnactaagtcactaataaataactcaagtttcgggacgggagggaaccaaggggttacggagtaagtactaaaacggacgtacgttgggacctggccgaaactacgttctacgttccttactactttccccg

SEQ ID NO: 401006 - DNA, 549 bp, Homo sapiens
  misc_feature: GZ8MTXP02FK3P9.15.28.C06.1.454.CMB.2.raw
  modified_base (393)..(393): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtccaccatcacttggcccggccagtcagagtatactaatggttgctggttcagacagaaacgaggaacgaccccaaagtcctagatctctcgccgccttctactttgacgtaaaggtcgggtccatcgaaggtcaggccgcagtgatcgtaggacagtaattcgagtccacacatcagctacgctgcncgctgacttatttcgactaacttactactagacctaagtcgactaaataactattcgtaggttacgggacgggaagggtaaccgaagggtaggaactactaaacgaaacgtacgtggtacgctacgaacactagtcgtactcctacgtccttcccg

SEQ ID NO: 401007 - DNA, 599 bp, Homo sapiens
  misc_feature: GZ8MTXP02FVAHD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtccaccatcacttggccggccagtcagagtattaactaagtggttggtctggttcagcagaaaccgaggaaacgaccccaaaagtcctagatctctcgccgtcctctactttggactaaagggttcggggtaccctagtacgtaaggttcgaggcccggacgaggtggtactcgtaggggacaggtaacttcgacgtcctaccaaccataccagccaacggtccctagcacgtctgacgttagttttcgaccttaacttactactcgacctaagtacactaataaactatcgtacgtttacgggacggaagggacctaaggggtagaacgactaaacgaaacgtacgtaggtcgcttacgaacctactacgttcgtcgtacttactactttcccg

SEQ ID NO: 401008 - DNA, 541 bp, Homo sapiens
  misc_feature: GZ8MTXP02J13G6.15.28.C06.1.454.CMB.2.raw
  modified_base (423)..(423): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaacgccccaaaagtcctgatctctgccgcctctactttgcaaagtcgggtccatcaaggttcagccggcagtggatcgtgggacagaattcagtctacacatcagcagcctgcagcctgacgtatttcgactaacttactactgaccaagtnactaataataatcagtttcgggacgggtacgggaaccgaagggtggaacgataaccgaaaacgtacgttaggacggacctaggccaaaccttacgtcttacgttccttactacttccg

SEQ ID NO: 401009 - DNA, 547 bp, Homo sapiens
  misc_feature: GZ8MTXP02GNIR5.15.28.C06.1.454.CMB.2.raw
  modified_base (344)..(344): a, c, t, g, unknown or other
  modified_base (394)..(394): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctagatctctgccgcctctactttgacaaagtggggtcccatcgaaggttcagccggnagtggatcgtgggacagaattcagtctcacatcagcagcctagcagtccngacgtattttgactaacttacctactgaccaagtgactaataaactaaatctaagtttcgggaggtacggggaaccaagggttcggaagtatacgaaaacggaactaggtacggctaggccaaccgattcgtacgttacttcgaatttccccg

SEQ ID NO: 401010 - DNA, 538 bp, Homo sapiens
  misc_feature: GZ8MTXP02IOIMN.15.28.C06.1.454.CMB.2.raw
  modified_base (172)..(172): a, c, t, g, unknown or other
  modified_base (402)..(402): a, c, t, g, unknown or other
  modified_base (526)..(538): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatggggccgattcaccgtctccagagacgacgccaagaactcaactacatctgcaaatgaaacaacctgagagccgaggacacggctgtgtattactgtgtgagagattgttctgcggttggggcccaggggaaccctgggtccaccgtctcctcacgcctccaccgagggcccagtccggtccttcccccgtggcccncccgtgcctccgaggcgccacctcgagacgcacgacgcggcccgtgggctgcccgtggtacaaggtacctacgttcccgctacgtagactggacggcgggctgggacgaagggcacgagtacgnnnnnnnnnnnnn

SEQ ID NO: 401011 - DNA, 528 bp, Homo sapiens
  misc_feature: GZ8MTXP02FVC30.15.28.C06.1.454.CMB.2.raw
  modified_base (352)..(352): a, c, t, g, unknown or other
  modified_base (357)..(357): a, c, t, g, unknown or other
  modified_base (367)..(367): a, c, t, g, unknown or other
  modified_base (375)..(375): a, c, t, g, unknown or other
  modified_base (384)..(384): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggttcagcagaaaccagggaaacaccccaaaagtcctgatctctgccgcctctactttgacaaaggtcggggtccatcgaaggttcagccggcagtgatcgnggacngaatcagtcncacatcancagcctgcngcctgacgtattttgactaacttactactgaccaagtgactaataaactatctacgtttcgggacggaagggtaccgaaagggtggaagtacgtacgaaaacgtacgtggtacgctagaaccacatctgtcttacactttcccg

SEQ ID NO: 401012 - DNA, 586 bp, Homo sapiens
  misc_feature: GZ8MTXP02IHVDW.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccagggaaacgacccccaaaagtcctgatctctgcccgcctctactttgcaaagtcggggtcccatcaaggttcagccggcagtggatcgtgggacagtaattcaagttcctaccaccatcagcagcctgcagccctgacgtattttgacctaacttactactgaccctaagtcgctaaataaattaactctaagtttacggggacgggaacggggtaacccgaaagggtacggtaaggaacttaaccggaaaaacggtacgtaggtacggtaccgttacggaacctacccgtaatccgttagtcctttacacctttccccg

SEQ ID NO: 401013 - DNA, 587 bp, Homo sapiens
  misc_feature: GZ8MTXP02HZ82Z.15.28.C06.1.454.CMB.2.raw
  modified_base (249)..(249): a, c, t, g, unknown or other
  modified_base (265)..(265): a, c, t, g, unknown or other
tcagtctacgtagccacgaccggtgctcgatttagagctcacgtattgggtttgggggagtcagactcagtcaggacacagcatggacatgagggtcccccgctcagctcctggggctcctgctgctctggctcccaggtgccaaatgtgacatccagatgacccagtctccgtccacctgtctgcatctgtcggagacagagtcaccatcacttgccggcagtcagagtatactaatggtgctggttnagcagaacaggaaacncccaaaagtcctagatctctcgccgcctctactttgactaaaggtcggggtacccagtacgtaaggttcaggtcccggacaggtggatcgtagggacagattcagtcctacacatcacgcagcctgcacgctagacgtatttcgactaaacttactacgtagtacgtaagtgacaattaaataactacgtaagtttcgggacggacgggtaaccgaagggttcggaaacgtacgtaaccaaaaacgggtactttagggacggtacctacggaaccctaaccgtaacgttaccgttcgtttaccttacgtaacctttcccccg

SEQ ID NO: 401014 - DNA, 551 bp, Homo sapiens
  misc_feature: GZ8MTXP02F3J8W.15.28.C06.1.454.CMB.2.raw
  modified_base (256)..(256): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattaactaatggttggctggttcngcagaacaggaaacgaccccaaaagtcctgatctctcgccgcctctactttgacgaaaggtcggggtacccatcaaggttcaggcccggcaggtggactcgtaggggacagaattcagtcctcacatcagcacgcctgacagcctgtacgtattttcgaccttaacttactactacgacctaagtcactaataaacgtatacgtagtttcgggaggtaacgggacgtaagggtacggaagactaacgaaaacgtacgtgtacggctgaacgaactctctcgtctactacttcccg

SEQ ID NO: 401015 - DNA, 596 bp, Homo sapiens
  misc_feature: GZ8MTXP02HDTLU.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattactaaagtggttggcctggttcagcaagaaaccgaggaaacgaccccaaaagtcctagatctctcgcccgccttctactttgactaaacggtcggggtacccatacgtaaggttcaggcccgggacaggtggactcgtagggacaggaatttcagtctacacatcagcacgctgcagcctgacgtatttgacctaacttactactacgacctaagtcactaataaatactctagtttcgggacgggtaacgggaccgaaggggttaggaacgtacgtaaaccgaaaacggtacgtacgggttacggacttacggaaccctaacgtacgttccgtacgttcctttacgaacctttccccg

SEQ ID NO: 401016 - DNA, 594 bp, Homo sapiens
  misc_feature: GZ8MTXP02H107W.15.28.C06.1.454.CMB.2.raw
  modified_base (197)..(197): a, c, t, g, unknown or other
  modified_base (367)..(367): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccgggcagtcagagtattactaaatggttggcctggttcagcagaaaccagggaaagaccccaaaagtcctagatctactcgccgccttctacttttgacaaaaggtcggggtacccagtcaaggttcaggccggacagtggatcgtggacngaattcagtctcacatcagcacgctgcagcctgacgtatttagctaacttactactcgacctaagtacgctaataaataactcgttaagttcggacgggtaacggggaaccgtaaaggggtaggaacgtaaagtaaccgtaaaaacggaaaaccgttggtacgggtacttacggaaccgtaaccgtaacttccgttaacggttccctttacttaacggtttcccccg

SEQ ID NO: 401017 - DNA, 543 bp, Homo sapiens
  misc_feature: GZ8MTXP02JAZ86.15.28.C06.1.454.CMB.2.raw
  modified_base (172)..(172): a, c, t, g, unknown or other
  modified_base (311)..(311): a, c, t, g, unknown or other
  modified_base (389)..(389): a, c, t, g, unknown or other
  modified_base (532)..(534): a, c, t, g, unknown or other
  modified_base (536)..(543): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaagggctggagtgggtggccaccatacaaaaagntggaagtgacacaacctatgtgaactctgtgatgggccattcaccgtctccagagacgacgccaagactcactacatctgacaaatgaacacctgagagccgaggacacggctgtgtattactgtgtgagagatgttcnggtcgttggggccaggggaccctggtccaccgtctcctcacgcctcaccaggcccagtccggtcctcccccgtggccnccctgcctccaggacgccacccgtccgagacgcaccgagccggcctggggctcgcctggtacaacggtccttacgttcccgacgttacgtagaccgtggacggccggggtctacgggacgaaagggccgacgagtaggcgcgnnngnnnnnnnn

SEQ ID NO: 401018 - DNA, 583 bp, Homo sapiens
  misc_feature: GZ8MTXP02G1K7E.15.28.C06.1.454.CMB.2.raw
  modified_base (371)..(371): a, c, t, g, unknown or other
  modified_base (538)..(538): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggcccccaggtgccaaatgtgacatccagatgacccagtctccgtccaccctgtctgcatctgtcggagacagatcacatcacttggccgggccagtcagagtattactaagtggttggcctggttcagacaagaaaccgaagggaaacgaccccaaaagtcctagactctctcgcccgtccttactactttgacgtaaaggtcgggtacccatcgaaagttcaggcgccagtgatcgtgganagtattcagtcctacaccatcagcacgcctgcacgcctagacttatttcgactaactttactactcgacctaagtcgaactaataaatactacgtagtttacgggacggttacgggaaccgtaagggaggaacgtagtaaccgaaaacgtaacgtaggtacggtacncggtaccaacgtactccgttagtccttactccgttaccttccccg

SEQ ID NO: 401019 - DNA, 555 bp, Homo sapiens
  misc_feature: GZ8MTXP02GSK0Q.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtgcctggttcagcagaaaccaggaaacgaccccaaaagtcctagatctctgccgcctctactttgacaaaggtcggggtcccatcgaaggttcagccggcagtggatcgtgggacagaattcagtctacacatcagcacgcctagcagccctagacgtatttgacctaacttactactgacctaagtgactaataaatacttacgtagtttcgggacggaagggtaccgaaggggttacgaagtactacgaaaacgtacgtggtacggactacggaaccgtaccattccgtacgttcttactactttccccg

SEQ ID NO: 401020 - DNA, 530 bp, Homo sapiens
  misc_feature: GZ8MTXP02G79Q7.15.28.C06.1.454.CMB.2.raw
  modified_base (437)..(437): a, c, t, g, unknown or other
  modified_base (515)..(515): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttgccgggccagtcagagtattactaaatggttgcctggttcagcagaaaccagggaaacgaccccaaaagtcctagatctctcgccgcctctactttgactaaaggtcggggtaccagtcaaggttcagccggcagtggatcgtagggacaggtaattcagtctacgacatcagcacgctgcagcctgacgtatttcgactaacgttactactgactaagtnactaataatatcagtttcggcggtaaggacaagggtcgagatacgaaacgtacgtgtacgctagaacacgtactcgtntccttcacgtttccc

SEQ ID NO: 401021 - DNA, 532 bp, Homo sapiens
  misc_feature: GZ8MTXP02F85DZ.15.28.C06.1.454.CMB.2.raw
  modified_base (270)..(270): a, c, t, g, unknown or other
  modified_base (388)..(388): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaaacgaggaaacnccccaaaagtcctgactctctgccgcctctactttgacaaaggtcggggtcccatcgaagttcaggccggcaggtgatcgtagggacaggattcgagtctacaccgatcagcacgccngcagcctgtacgtatttcgactaacgttactactcgacctaagtcgactataactaatcgtagttcggacggtagggacgaagggtacgagactacgaaaacgtacgtagtacgctagaacacgagtctagtcttcacttcccg

SEQ ID NO: 401022 - DNA, 562 bp, Homo sapiens
  misc_feature: GZ8MTXP02F95RR.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctactgccgctctactttgcaaagtggatcccatcaaggtcagcgcagtggatcgtgggacagaattcagtctcaccatcagcagcctgcagcctgacgtattttgactaaacttactactcgacctaaagtgacaataaataaatctaagtttacggggacgggtaacgggggaaccgtaaaaggggtagggaaacggaaacttaccgaaaaacgtaaccgttaggtcgggtactggaccaacctacttccttgttacctttactaaccg

SEQ ID NO: 401023 - DNA, 574 bp, Homo sapiens
  misc_feature: GZ8MTXP02JO22O.15.28.C06.1.454.CMB.2.raw
  modified_base (359)..(359): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctcgccgcctctactttgcaaaaggtggggtccatcaaggtcagccggcagtggatcgtgggacngaattcagtctcaccatcagcagcctgcagcctgacgtattttcgacctaaactttactacttacgaccctaaggtacactaattaaactaatcgttaagttcgggtacgggacgggtaacgaagggtacggaagaacttaacgaaaacgtaaccgttaggtaacggtcgtacggaacctaaccgacttacgtacgttccttactctttaccccg

SEQ ID NO: 401024 - DNA, 581 bp, Homo sapiens
  misc_feature: GZ8MTXP02ILSPA.15.28.C06.1.454.CMB.2.raw
  modified_base (358)..(358): a, c, t, g, unknown or other
  modified_base (477)..(477): a, c, t, g, unknown or other
  modified_base (490)..(490): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccaggcccggggggtccctgagactctcctgtgaagcctctggattcaccttgagcacttattggatgacttcggggtccgccgaggctccgaggggaaggggctggagtggggtggccaccgataacaaaaagntggaaagtgaccacaacctatgtagaactctggtgagtggggacctattccgaccgtctaccgagacgacgacgaccaaagactcgaactacatctgaccaaatgaaacacctgagacnccgaggacacggntgtagtattacgtgtagttgaagagacttggttacctggtcgggttcggggaccgtaacggggtacccttgggtccctaccggttctcccg

SEQ ID NO: 401025 - DNA, 546 bp, Homo sapiens
  misc_feature: GZ8MTXP02F2RWZ.15.28.C06.1.454.CMB.2.raw
  modified_base (351)..(351): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttggctggttcagcagaacaggaaacgccccaaaagtcctgatctctgccgcctctactttgacaaagtggggtcccatcaaggttcagccggcagtgatctgggacngaattcagtctcacatcagcagcctgcagctgacgttatttcgactaacgttactactcgacctaagtcactaattaaataacttactaggtttaccgggacggtaacggggaaccgtaagggtaggacgaactaacgaaaacgtacgtaggacgtacgtagaaccactactcgtcgttacttctactttccccg

SEQ ID NO: 401026 - DNA, 525 bp, Homo sapiens
  misc_feature: GZ8MTXP02HP2YV.15.28.C06.1.454.CMB.2.raw
  modified_base (250)..(250): a, c, t, g, unknown or other
  modified_base (263)..(263): a, c, t, g, unknown or other
  modified_base (425)..(425): a, c, t, g, unknown or other
  modified_base (435)..(435): a, c, t, g, unknown or other
  modified_base (512)..(512): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggttgctgttcngcagaacaggaanaccccaaagtccagatctctcgccgctctactttcgacaaaggtcggggtcccagtcgtaaacggttcaggccggctaaggtggactcgtggggaacagtaaacttcagtctaccacatcagcacgctgcagcctggacttatttcgactaacttactactnaccgtaagtnacaataataatctagttcggacggagggaccgaagggtacgaaggtacacgaaaacgactcggtgctagctacatcngtactcattcccg

SEQ ID NO: 401027 - DNA, 577 bp, Homo sapiens
  misc_feature: GZ8MTXP02GK8OO.15.28.C06.1.454.CMB.2.raw
  modified_base (368)..(368): a, c, t, g, unknown or other
  modified_base (386)..(386): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaaccagggaaaagccccaaaaagtcctgatctctgccgcctctactttgcaaaagtggggtcccatcaaaggttcagcggcagtggatctggggaacagaaattnagtctcacatcagcagcngcagctgacgtatttagtactaacttaactaactacgaccaagtagacaataaaataaataactaacgtttacggtacgggaacggggaaacgaaacgggtaagggaaggaaacgtaaacgtaaaacgaaaacgtacgtacggtacgtacgaaccgaacctaacgtacttacgttacctttactacttacc

SEQ ID NO: 401028 - DNA, 589 bp, Homo sapiens
  misc_feature: GZ8MTXP02I90RX.15.28.C06.1.454.CMB.2.raw
  modified_base (364)..(364): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttgcctggttcagcagaacgaggaacaccccaaaagtcctgatctctgccgcctctactttgactaaaaggtcggggtaccctatcgtaaaggttcaggccggacagtggatcgtagggacngtaattcagtctcacatcagcacgcctgcagcctgacgttatttcgactacttacgtactgacctaagcactaataaatactacgtagtttacggggacggtaacggggaaccgtaaaggggtacggaaagtaacgtaaccggaaaaacgtacggtacggttacgggccttacggaacctaacccggtattaccggttcgttacctttcgtaacgttttcccccg

SEQ ID NO: 401029 - DNA, 555 bp, Homo sapiens
  misc_feature: GZ8MTXP02F15CR.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgctgttcagcagaacgaggaacaccccaaaagtccagatctctgccgctctactttgacaaaggtcgggtcccatacaaggtcagccggcaggtggatcgtaggggacagaattcaagttcctacacatcaagcacgcctgcagcctagacgtattttgacctaacttactactagaccaagtcgactaataaactaatcgtaacgttcgggacgggtaacgggaaccgtaagggtacggaaggtaactacgaaaacggacgtagtacggactacgcctaactacttctagttaccttactactttcccg

SEQ ID NO: 401030 - DNA, 542 bp, Homo sapiens
  misc_feature: GZ8MTXP02FVJLE.15.28.C06.1.454.CMB.2.raw
  modified_base (357)..(357): a, c, t, g, unknown or other
  modified_base (394)..(394): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattaactaatggtgctgttcagcagaacaggaacgaccccaaaagtcctagatctctcgccgtcctctactttgactaaaggtcggggtcctatcgaaggttcaggccggcagtgatcgtaggacngtaattcagtcctcacatacagcagcctgacagtccngtacgtatttcgacctaacttactactagaccaagtgactaataactaatactagttcggcggtaacgggaccaagggtagagaatacgaaaaccgtacgtaggtacgctacgaaccgacctagtacctgttacttctactttccccg

SEQ ID NO: 401031 - DNA, 533 bp, Homo sapiens
  misc_feature: GZ8MTXP02INTOY.15.28.C06.1.454.CMB.2.raw
  modified_base (198)..(198): a, c, t, g, unknown or other
  modified_base (399)..(399): a, c, t, g, unknown or other
  modified_base (405)..(405): a, c, t, g, unknown or other
  modified_base (429)..(429): a, c, t, g, unknown or other
  modified_base (500)..(500): a, c, t, g, unknown or other
  modified_base (519)..(519): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgcaaatgtgacatccagatgacccagtctccgtccaccctgtctgcatctggtcgganacagagtcaccatcacttgccgggcagtcagagtattactaatggtggctggttcagcagaacaggaacaccccaaaagtcctagatctctcgccgcctcttactttgactaaacggtggggtacccatcaaggttcagccgcagtggatcgtagggacagtacttcagtcctcacatcagcacgctagcagctgaacgtnttttanactacttacacttacgactaagtnactaaataataactctagtttcgggacggacggaacgaaggtaggagtatacgaaaacgacgtggtacggntacggaacactactcgttntcttcactttcccg

SEQ ID NO: 401032 - DNA, 574 bp, Homo sapiens
  misc_feature: GZ8MTXP02GF0IW.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttggcctggttcagcagaaaccagggaaacgaccccaaaagtcctagatctctgccgcctctactttgactaaaggtcggggtcccatcgaaggttcaggccggcaggtggatcgtaggggacaggtaaattcagtcctacacatcagcacgcctgcagcctagacgtacttttgactaacttactacgtcgaccgtaagtcgactaattaaataagttactacggtttacggggacgggtaacggggtaaccgaaggggttacggaagtaacgtaacgaaaacgtaacgtgtacggctagaacaccgattctcgtactctactttcccg

SEQ ID NO: 401033 - DNA, 578 bp, Homo sapiens
  misc_feature: GZ8MTXP02JK68H.15.28.C06.1.454.CMB.2.raw
  modified_base (379)..(379): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagaccccaaaagtcctagatctctcgccgctctactttgcaaagtggggtccatcaaggttcagccggcagtggatcgtggacagaattcagtctcacatcacgnacgcctagcacgcctgacgtattttcgacctaacttaactactcgcccaaggttcacaattaaataactctaagtttccgggacgggaacgggtaacccgaaaggggttagggaacgaaacgttacgaaaacggtaaccgtaggttacgggccttacggaaccaaccgtaactcgttacgtcctttactactttccccg

SEQ ID NO: 401034 - DNA, 611 bp, Homo sapiens
  misc_feature: GZ8MTXP02H6JO3.15.28.C06.1.454.CMB.2.raw
  modified_base (273)..(273): a, c, t, g, unknown or other
  modified_base (350)..(350): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttgccgggccagtcagagtattactaaatggttggcctggttcagcagaacaggaaanaccccaaaagtcctgatctctgccgcctctactttgcaaagtgggtcccatcaggttcagccgcagtgatctggacngattcagtctcacatcagcagccctagcacgtcgtacgtacgtttacgtttcgaaccttaactttaccttaacgtacgtaaccgtaaggtactactaaaattaaataacttacgttacggtttaccggggacggggtaacgggaaacccggtaaaggggttaggaaacgtaacgtaaaccgtaaaacggtaaccgttcgggtaacggtctacggaaccgtaaaccacgtttcggtactttacctttactacctttcccccg

SEQ ID NO: 401035 - DNA, 614 bp, Homo sapiens
  misc_feature: GZ8MTXP02I0C21.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgccaccctgtctgcatctgtcggagacagagtcaccatcacttgccgggccagtcagagtattaactaaatggttggcctggttcagcagaaaccaggaaacgaccccaaaagtcctagatctctcgcccgcctcctactttgactaaaggtcggggcccatcaaggttcaggccgcaggtggactcgtaggggaccaggtaattcgagttcctccaacctatccaagccagcctgcctagccctagacgttattttcgactaacttactactcgacctaagtcactaactaaatactactacggtttacgggacgggtaagggaaccgtaagggttagggaacgtaaacgttaaccgaaaaacggtaccgttagggtacggtccgttacggaacctaaccttacgttacctttcgttaccctttccgtaacttttcccccg

SEQ ID NO: 401036 - DNA, 616 bp, Homo sapiens
  misc_feature: GZ8MTXP02HDQSH.15.28.C06.1.454.CMB.2.raw
  modified_base (204)..(204): a, c, t, g, unknown or other
  modified_base (290)..(290): a, c, t, g, unknown or other
  modified_base (347)..(347): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctcccgtccaccctgtctgcatctgtcggagacagngtcaccatcacttcggccggcagtcagagtattactaagtggttgctgttcagacaacgaacgaggaacgacccaaagtctgatcnctcgccgtctctacttgacgtaaggtcgggtaccagtacgtaaggtcgaggcccggngtaggtgacgtcggtaggaactaggtacttcgacgtacctcctaacgtactccgaacgtccaaccggtccgtacggctaaccgtccgttagtacgttacgtttacgaccttaacttaactaccgtcgacgtaacgtgtacgtaaataacgtactacggtacggttacgggacggtaacggtaacggtaaggggtacgtaagtacgtaacgtaaagtacggtaacgtggtacgactcgacctacggtcttacgtcgttacctcttacccg

SEQ ID NO: 401037 - DNA, 600 bp, Homo sapiens
  misc_feature: GZ8MTXP02GXVCK.15.28.C06.1.454.CMB.2.raw
  modified_base (309)..(309): a, c, t, g, unknown or other
  modified_base (447)..(447): a, c, t, g, unknown or other
  modified_base (454)..(454): a, c, t, g, unknown or other
  modified_base (461)..(461): a, c, t, g, unknown or other
  modified_base (486)..(486): a, c, t, g, unknown or other
  modified_base (490)..(490): a, c, t, g, unknown or other
  modified_base (500)..(500): a, c, t, g, unknown or other
tcagtctacgtagccacgaccggtgctcgatttagagctcacgtattgggtttgggggaagaggaagactgaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccgagcctacggaggggacggngtaggaggtggcggacccaacaactaaaagaaaaagtgtaaggaagtacgaacaaaccaaactatagtataaccctgtgagtaggtcggacctactccaccgtcacgaagacgacgaccgacaaacactcaactaacngtacaanaacaaanacgaacacgagacgacgacgagtangtgntagtatatgngtgagagagtgtcgtggtcggtacggggtacggaccgaaccggtccgtacggtaaccctcccgttccaccgtacgacccgtacccgtaacccgaaaccgg

SEQ ID NO: 401038 - DNA, 604 bp, Homo sapiens
  misc_feature: GZ8MTXP02I37LV.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggtttcagcagaaaccaagggaaacgaccccaaaagtcctagatactctcgccgcctctactttgacctaaaagtcggggtcccatcaaggttcagccggcagtggactcgtgggacaggtaattcagttctacacatcaagcagcctgcagcctgacgtatttcgactaacttactactcgaccctaaagtcgactaataaattaactcgtaacgtttcgggaccggtaagggaacccgtaagggttacgggaaagaacgttaacgaaaaacggtaacttagggttacggaccgtttacggaaccgtaacccgtagttaccgttcgtttacctttacctaacggtttcccccg

SEQ ID NO: 401039 - DNA, 638 bp, Homo sapiens
  misc_feature: GZ8MTXP02G08AV.15.28.C06.1.454.CMB.2.raw
  modified_base (101)..(101): a, c, t, g, unknown or other
  modified_base (260)..(260): a, c, t, g, unknown or other
  modified_base (264)..(264): a, c, t, g, unknown or other
  modified_base (306)..(306): a, c, t, g, unknown or other
  modified_base (350)..(350): a, c, t, g, unknown or other
  modified_base (358)..(358): a, c, t, g, unknown or other
  modified_base (411)..(411): a, c, t, g, unknown or other
tcagtctacgtagccacgaccggtgctcgatttagagctcacgtattgggtttgggggagtcagactcagtcaggacacagcatggacatgagggtccccnctcagctcctggggcgtcctgctgctctggctcccaggtgccaaatgtgacatccagatcgacccagtctcccgtccaccctgtctgcatctggtcggagacagagtcaccatcacgttggcccgggccagtcagagtattactaagtggttgctgttnaganaagaaaccgaaggaacaaccccaaagtcctgatctctcgccnccttctactttgactaaacgggtcgggtccatcgtaaaggtcgngacccggnagtcgatcgacggaacagtattcacgtctaccacactcagctacgccgtcganaccgcttacggaagtttcgtttacacctaaacctttacctacgtacgaccgtaaagtcactaaattaaattaacgtccgtaaaggttccgggggacgggtaaaccgggggaactaaagggggtagggaacaacttaaaccggaaaacgtaaccggtttggaacccggtcgtaaccgaaccgtaacgttacgttcgttacgttacctttcccgtaactttccccccgg

SEQ ID NO: 401040 - DNA, 588 bp, Homo sapiens
  misc_feature: GZ8MTXP02GDLW1.15.28.C06.1.454.CMB.2.raw
  modified_base (199)..(199): a, c, t, g, unknown or other
  modified_base (267)..(267): a, c, t, g, unknown or other
  modified_base (355)..(355): a, c, t, g, unknown or other
  modified_base (365)..(365): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtattactaatggtgctggttcagcagaacaggaaanaccccaaaagtcctagatctctcgccgctctactttgacaaaggtcgggtcccagtacgaaggttcaggccggcagtgatcgtggacngattcagtcncacatcagcagcctgcagcctagacgtatttacgactaacttactactcgacctaagtcgactaaataaactaactacgtacgtttacggggacgggaacggggtaaccgaaagggttagggaaacgtaaacgtaaaccgaaaaaccggtaacgttaggttacgggacttacggaacctaaccgtaacgttaccttgtttacctttactaaccgtttcccccg

SEQ ID NO: 401041 - DNA, 734 bp, Homo sapiens
  misc_feature: GZ8MTXP02F22JD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgaccagtctccgtccaccctgtctgcatctgtcggagacagagtcaccatcacttgccggcagtcagagtattactaagtggttggctggttcagacaagaaacgaggaaacacccaaagtcctagatctactcgcccgtccttacttacgtttagacgtaaaacgggtcggggtaccctagtaccgtaaggttcgaacggcccggacgtaaggtggattacggtacgggaactaggtaaacttacgtaacggtacctaccaaacctacgtacgacgaccgacggtaccctacgaccgtaacgtcccgtacggtaacctttaagttttacgaaccttaaaacctttaaccttaaccgttaccgaacccgttaaaggtacgtaaacccttaaaatttaaaacgttaaacttaccggttaaacggttttacgggggaaccggggtaaacgggtaaacccgggtaaaaggggttaacgggaaaacgtaaacgtaaaccggtaaaaaccgtacgttaggtaacggtctacgaaccgtaactacgttaccgttctttaacgttcctaacgtttcccccg

SEQ ID NO: 401042 - DNA, 705 bp, Homo sapiens
  misc_feature: GZ8MTXP02JK6JR.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagagtcaccatcacgttcggccgggcagtcagtagttattactaagtggttcgccttggttcagacaagaaaccgagggaaacacccctaaaagtcctagactctctcgccgtccttctacgtttgacgtaaacgggtccgggtaccagtcgtaaggttcgacggcccggtactaggtggtaacgttcggacggggaactaggtacttacgacgtaccactaacctatcaaacgcacgcccgtgactacgtacctaggtaacgtttagtttacgaaccttaactttaaccgtaccgttaggaacccttaaggtacgtaaacttaaataaaacttaacgtacgtttaacgggtttaccggggaacgggtaaacggggtaaaccgtaaggggttaacggaaacggtaaacgtaaaaccggtaaaacggtaaccgttgggtaccggtaccttacggaacccgtacttaacgtttcgttacgtttacctttaccgtacctttcccccg

SEQ ID NO: 401043 - DNA, 586 bp, Homo sapiens
  misc_feature: GZ8MTXP02INS9G.15.28.C06.1.454.CMB.2.raw
  modified_base (356)..(356): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggcagtcagagtattactaatggttgcctggttcagcagaaccaggaaagaccccaaaagtcctgatctctgccgcctctactttgctaaaggtcggggtcccatcaaggttcagccggcagtgatcgtgggacngatcagtcctcacatcagcacgctgcagcctgacgtattttgacctaacgtttactacttgacctaagtcgactaattaaataattactacgtttacgggacgggtaacggggaaccgtaaaggggttaggacgtaaagtaccgaaaaacggtaaccgttaggtacgggtccttacggaacctaacccgtaagttcccgttacggttcctttacctacggtttacccccg

SEQ ID NO: 401044 - DNA, 570 bp, Homo sapiens
  misc_feature: GZ8MTXP02G3VJ2.15.28.C06.1.454.CMB.2.raw
  modified_base (434)..(434): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggttgcctggttcagcagaaaccagggaaacaccccaaaagtcctagatctctcgccgcctctactttgacaaaggtcggggtcccatcaaggttcagccggcagtggatcgtagggacagtaacttcagtctcacatcagcacgcctgcacgctgacgttatttcgactaacttactactacgacctaaggtnactaataaacttaactactacgtttacgggacggtaacgggaaccgaaggggtaggaacgtaataaccggtaaaacgtaacgtggtacggacctagaaccgtaaccgtattacctagttccttactactttccccg

SEQ ID NO: 401045 - DNA, 612 bp, Homo sapiens
  misc_feature: GZ8MTXP02FYVTD.15.28.C06.1.454.CMB.2.raw
  modified_base (377)..(377): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccggcagtcagagtattactaagtggttggcctggttcagcaagaaaccagggaaacaccccaaaagtcctagatctctcgccgtcctctactttgactaaaggtcgggtccatcgaaggtcagccgcagtgatcgtagggacagtattcagtctcacntcagcagctgcagctagacgtatttgacctaacttacctacttcgacctaaaggtctaactaattaaactaattactaacggtttccggggacggggtaacggggtaccggtaaaaggggtacgggaaaggtaaacgttaaaccgaaaaacggtaaacgttcgggttaacgggccgttacggaacccgtaacctacggtttaccttcggttacctttaccgtacgtttacccccg

SEQ ID NO: 401046 - DNA, 539 bp, Homo sapiens
  misc_feature: GZ8MTXP02J189Q.15.28.C06.1.454.CMB.2.raw
  modified_base (344)..(344): a, c, t, g, unknown or other
  modified_base (350)..(350): a, c, t, g, unknown or other
  modified_base (367)..(367): a, c, t, g, unknown or other
  modified_base (434)..(434): a, c, t, g, unknown or other
  modified_base (487)..(487): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggccagtcagagtattactaatggttgctggttcagcagaacaggaaacaccccaaaagtcctagatctctcgccgctcttactttgacgaaagtcgggtacccatcaaggtcagcgcagtgatcngggacngattcagtctacactancacgcacgcctggcacgcccgtagaaccggttattttacgactaacttactacgttcgacctagtanactaattaaatattacgtagtttcggacgggtaacggacgtaggacggagtanaacgaaacggacgtcgcggctacgaactactactctgttacctcacttcccg

SEQ ID NO: 401047 - DNA, 601 bp, Homo sapiens
  misc_feature: GZ8MTXP02IT5X2.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggttggcctggttcagcagaaaccagggaaacgaccccaaaagtcctagatctctcgccgcctctactttgacgaaaacggtcggggtacccagtaccgaaggttcacggccggcgtagtgggactcgtagggacaggtaaacttcgagtcctacaaccgatcagcctagcctgcagcctagacgttatttcgactaactttactactgaccctaaagtcgactaaataacttaatcgtaacgtttaccgggacgggtaacgggaccgtaaagggttagggaacgaacgttaacgaaaacgtacgtggtacggtctacggaacctaacgtactcgttcgttaccttactactttaccccg

SEQ ID NO: 401048 - DNA, 615 bp, Homo sapiens
  misc_feature: GZ8MTXP02IZS72.15.28.C06.1.454.CMB.2.raw
  modified_base (259)..(259): a, c, t, g, unknown or other
  modified_base (346)..(346): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgtagacagagtcaccatcacttgccgggccagtcagagtattaactaaatggttggcctggttcngcagaaaccagggaaacgaccccaaaagtcctagatctactgcccgcctctactttgacaaagtcgggtccatcaaggtcagccgcnggtgatcgtagggacagtaattcagtctcaccatcagctagcccgtgcagccgttgacgttagtttagaccttaaacttacgtactacggaccctaaggtctactaattaaacttaactcgttaagtttaccggggacgggtaacggggaacgaaaacggggttcggaaagtaaacgtaacggaaaaccgtaacgttgggtaaccggtctaaccggtaacctaaaccgtcgttacccgttcggtttacttaccgtaacgttttcccccg

SEQ ID NO: 401049 - DNA, 533 bp, Homo sapiens
  misc_feature: GZ8MTXP02GD5Q0.15.28.C06.1.454.CMB.2.raw
  modified_base (300)..(300): a, c, t, g, unknown or other
  modified_base (348)..(348): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccnccaggctccaggggaaggggctggagtgggtggccaccatacaaaagntggaagtgaccacaacctatgtgaactctgtgatggggccattcaccgtctccagagacgacgccaagaactcactacatctgacaaatgaaacaacctgagagccgagacacggctgtgtattactgtgtgagagctgttctgtcggttggggccacggggaccctgggtccaccggtctcccg

SEQ ID NO: 401050 - DNA, 708 bp, Homo sapiens
  misc_feature: GZ8MTXP02JNJKA.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttggctggttcagcagaaccaggaaacgaccccaaaagtcctgatctctcgccgcctctactttgacaaaggtcggggtcccatacgaaggttcagcccggcgtaggtggaatcgtaggggaactaggtaaactttacgaacgttcctacaaccctagtaccaaacggccaaacggtcccttaggccaacgggtcccttacggtaaccggttaatttttccggaaccttaaacctttaaaccttaccgttacggaccctaaaaggttcgaacctaaaattaaacttaaacttacgtacggttttaccggggacggggtaaacggggaacccgtaaagggggttaggggaaacggaaacgtaaaccggtaaaaccggtaaacggttcggggttacggacccgttaacggaacccgtacccgttaacttacggttcgttaccctttaccgttaaccgttttcccccg

SEQ ID NO: 401051 - DNA, 663 bp, Homo sapiens
  misc_feature: GZ8MTXP02HPHT7.15.28.C06.1.454.CMB.2.raw
  modified_base (252)..(252): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagagtattactaatggtgctgttcngcagaacaggaacacccaaagtcctagatctctcgccgcctcttactttgacgtaaaggtcggggtccctaagtacgtaacggttcgacggtcccggacgtaggtgtattcggtcgggaacaggtaaattcaagttcctacaccgataccgagacgacgtcccgtagccagtccctgacgttatttcgactaaacttactacgtcgaccgtaagttacgactaattaaactaacttacggtacgttttaccgggggacgggaaaccgggggtaaccgtaaagggggttacggaaaggtaaaccgttaaaccgaaaaccgggtaaccgtttacgggacggttaccgttacggaacccgtaaccgtaacgtttccgttacggtttacccttttacctaaccttttccccccgg

SEQ ID NO: 401052 - DNA, 534 bp, Homo sapiens
  misc_feature: GZ8MTXP02GMN9Q.15.28.C06.1.454.CMB.2.raw
  modified_base (431)..(431): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggtgctgttcagcagaacaggaacaccccaaagtcctgatctctcgccgcctctactttgacgtaaaggtcggggtacccagtacgaaggttcaggccggcaggtggatcgtaggggacagtaattcagtctacacatcagcagcctgcacgctagtacgtatttcgactaacttactactcgacctaagtnactaataacttatacgtagttcgggacggaaggggtacgaagggtgagataacgaaacgtacgtgtacgctacgaaccactatctacgtcttctactttcccg

SEQ ID NO: 401053 - DNA, 520 bp, Homo sapiens
  misc_feature: GZ8MTXP02GFITT.15.28.C06.1.454.CMB.2.raw
  modified_base (429)..(429): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaaagccccaaaaagtcctgatctctgccgcctctactttgcaaaagtgggtcccatcaaggtcagccggcagtggatcgtgggacagaaattcaagtctcaaccatcagcagcctgcagcctgacgtatttgactaattactactgaccaaagtcganaataaataaatcgaagtttcggacggagggaaccaaagggtggaagatacaaaacgtaacgtgtaggctagcacatctctcttacattccc

SEQ ID NO: 401054 - DNA, 588 bp, Homo sapiens
  misc_feature: GZ8MTXP02FVDA3.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggttgctggttcagcagaaaccaggaaacgaccccaaaagtcctagatctctcgccgcctctactttgcaaaggtcggggtccatcaaggttcagccggacagtggatcgtgggaacaggaacttcaagttcctacacatcagcacgcctgcagcctagacgtattttcgactaactttactactacgaccctaaagttcactaaattaaactaaacgttactaacgtttcgggacgggtaacgggtaaccgaaaggggtacggaacgagtaaaccgaaaacggtaactcggttacggaccttacggaaccgtaaccgtatacgttcgttaccttactacgtttccccg

SEQ ID NO: 401055 - DNA, 533 bp, Homo sapiens
  misc_feature: GZ8MTXP02HEUZQ.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctagatctctgccgcctctactttgcaaagtggggtccatcaaggtcagccggcagtggatcgtggggacngaattcagtctcaccatcagcagcctgcagcctgacgtattttgactaaactttacgtactgacctaaagtgactaataaataatcaacgtttcgggacgggaagggaaccgaagggtacggagaatacgaaaacgaagtcgtacgactagctaccattctgtccttactacttccc

SEQ ID NO: 401056 - DNA, 532 bp, Homo sapiens
  misc_feature: GZ8MTXP02HKHF8.15.28.C06.1.454.CMB.2.raw
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacgttggccgggccagtcagtagtattactaagtggtgcctgttcagcagaacaggaacaccccaaagtcagatctctcgccgctctacttgacgtaaggtcgggtaccatacgtaaggttcagccggacagtcggatcgtgggactagtacttcagtctacacatcagcagcctgcacgtcctgtactatttcgactaacttactactgacctagtcactaataatactactagttcggacggtacggacgtagggtagacgacgtacgaaacgtacgtgtacgctacgcctactagttctagtctactctttcccg

SEQ ID NO: 401057 - DNA, 546 bp, Homo sapiens
  misc_feature: GZ8MTXP02GGBQP.15.28.C06.1.454.CMB.2.raw
  modified_base (427)..(427): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgcccgcctctactttgacaaagtggggtcccatcaaggttcagccgcagtggatcgtgggacagaattcagtctcacatcagcagccctgcagcctgacgtattttcgactaacttactactgacctaaagtnactaataaactaagtctaacgtttcgggacgggtaacgggaaccaaaggggtcggaagaattacgaaaacgaacgtgtacggctaggaaccaacctatctcgtactttacactttcccg

SEQ ID NO: 401058 - DNA, 535 bp, Homo sapiens
  misc_feature: GZ8MTXP02FKOVN.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggttcagcagaaaccgagggaaacgaccccaaaagtcctgatctctgcccgccttctactttgacaaaagtggggtcccatcaaggttcagccggacagtggatcgtggggacagaatcagtctacacatcagtcagtcctgcagcctgtacgtattttcgactaacttactactgaccagtgacaattaataattcaagtttccgggacggtaggaacgaagggtcgagactaacgaaaacgactaggtcgactcgaaccactaatctgttcttcactttcccg

SEQ ID NO: 401059 - DNA, 599 bp, Homo sapiens
  misc_feature: GZ8MTXP02HMATA.15.28.C06.1.454.CMB.2.raw
  modified_base (270)..(270): a, c, t, g, unknown or other
  modified_base (351)..(351): a, c, t, g, unknown or other
  modified_base (375)..(375): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagctctcctgtgagcctctggnttcaccttgagcacttattggatgacttgggtcccgcaggctccgagggagggctggagtgggtgccacataacaaaaagntaggaagtgacacaacctatgtanactctgtgagtcggggccattccaccgtctacctcacgccctcccaaccgaacgggcccacgtcccggtcccttcccccgtcggcccgtccccgtcggtcccttccgacgggacgcccacccgtcgacgacgccaacgcgcccggcccgtcggggcctcggccgttacggtaccgaaacggtccttaaccgtccgacgtacgtacgacctggacggtcggccgg

SEQ ID NO: 401060 - DNA, 570 bp, Homo sapiens
  misc_feature: GZ8MTXP02JF0TG.15.28.C06.1.454.CMB.2.raw
  modified_base (303)..(303): a, c, t, g, unknown or other
  modified_base (354)..(354): a, c, t, g, unknown or other
  modified_base (376)..(376): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaatggtggagtctgggggagcctcgtccaggccggggggtccctgagactctcctgtgaagcctctggattcaccttgagcacttatggatgacttgggtccnccaggctccgaggggaaggggctggaggtgggtggccacataacaaaaagntggaagtgacacaacctatgtnactctgtgagtgggccgattccaccgtctccctcacgccctccaccaacgggcccagtccggtccttccccctggcccgccctcgcctccacggacgccaccgtccgagacgcacgacgccggcccgtggggcctcgccgtcggtaccgaacggacctaccgttccgactacgtacgacgtcggacgcggggcg

SEQ ID NO: 401061 - DNA, 525 bp, Homo sapiens
  misc_feature: GZ8MTXP02FNSXX.15.28.C06.1.454.CMB.2.raw
  modified_base (332)..(332): a, c, t, g, unknown or other
  modified_base (341)..(341): a, c, t, g, unknown or other
  modified_base (346)..(346): a, c, t, g, unknown or other
  modified_base (364)..(364): a, c, t, g, unknown or other
  modified_base (381)..(381): a, c, t, g, unknown or other
  modified_base (396)..(396): a, c, t, g, unknown or other
  modified_base (405)..(405): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttggccggcagtcagatatactaatggtgctgttcagcagaaacaggaaacaccccaaagtcctgatctctcgccgcctctactttgacgtaaaggtcgggtccatcgagtcagccgnagtgatcgnggacngatcagtctcacatcgancagctgcagcctgactntttgactacttactncgaccagtnactaataactatacgtagttcgggaggtaacgggacgtaagggtaggaacaagtaaccgaaaagtaccgtggtacggctacggaacctaacgtacttcgtagttccttacactttccccg

SEQ ID NO: 401062 - DNA, 599 bp, Homo sapiens
  misc_feature: GZ8MTXP02G0N54.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggttgcctggttcagcagaaaccagggaaacgaccccaaaagtcctgatctctcgccgcctctactttgactaaagtggggtcccatcaaggttcagccggcagtggatcgtagggacagaattcagtcctcaaccatccagcaagccctgccagccctgaacgtattttagactaaactttaccgtacttacgacctaaaggttcacctaaattaaaactaacgttactaacgttttacggggaccgggtaagggaacccgtaaaggggttacggaagaacgttaacgaaaaaccggtaacgtggtacgggccttaggaacctaaccgtaacttctcgttcttccgaactttccccg

SEQ ID NO: 401063 - DNA, 527 bp, Homo sapiens
  misc_feature: GZ8MTXP02IG90V.15.28.C06.1.454.CMB.2.raw
  modified_base (251)..(251): a, c, t, g, unknown or other
  modified_base (253)..(253): a, c, t, g, unknown or other
  modified_base (264)..(264): a, c, t, g, unknown or other
  modified_base (271)..(271): a, c, t, g, unknown or other
  modified_base (273)..(273): a, c, t, g, unknown or other
  modified_base (416)..(416): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggtgctgtcngnagaacaggaancccaaancngatctctgccgctctactttgactaaagtgggtccatcgaaggttcagccggcagtggtatcgtgggacaggtaattcagtctacacatcagcagcctgacagcctagacgtatttcgactaaacttactactgacctaagtnactaataataatactagtttcgggacggtaggaccgaagggtcgaagtataacgaaaacggtactggtacgctacgaacctactacttctacgttcctactactttccccg

SEQ ID NO: 401064 - DNA, 546 bp, Homo sapiens
  misc_feature: GZ8MTXP02JAKDE.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggtcagccggcagtggatcgtaggggacagaattcagtcctcaccatcagcagcctagcagctagacgtatttgactacttactactgacctaagtgactaataaataactacgtagtttcgggacgggtaacgggtaaccgaaggggttaggagtaagtacgaaaacgtaaacgtgtacggctagaaccaccattctagtccttacactttccccg

SEQ ID NO: 401065 - DNA, 560 bp, Homo sapiens
  misc_feature: GZ8MTXP02FR44B.15.28.C06.1.454.CMB.2.raw
  modified_base (271)..(271): a, c, t, g, unknown or other
  modified_base (390)..(390): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaatggttggctggttcagcagaaccaggaaacnccccaaaagtcctagatctctcgccgcctctactttgactaaagtggggtcccatacgaaggttcagccggcagtggatcgtagggacagaattcagtctacaccatcagcagctgacngctgacgtatttcgactaacttactactcgaccaagtgactaataaataatactagtttacgggcggtaagggaccgtaaagggtcggaagtataaccgaaaacgtaacgtgggtacggacgttcggaactacccgtaacgttctaggttacctttactactttcccccg

SEQ ID NO: 401066 - DNA, 531 bp, Homo sapiens
  misc_feature: GZ8MTXP02HL6GY.15.28.C06.1.454.CMB.2.raw
  modified_base (433)..(433): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctagatctctgccgcctctactttgcaaagtcggggtccatcaaggttcagccggcagtgatcgtggggacagaattcagtctcaccatccagcagcctgcagcctgacgtattttcgactaacttactacttggaccctaaaggtnacaataaataatcaatttcgggacggtagggaaccaagggtgaagatacgaaaacgtaactaggtcgctaggcacactctgttccttctactttcccg

SEQ ID NO: 401067 - DNA, 545 bp, Homo sapiens
  misc_feature: GZ8MTXP02JCZK3.15.28.C06.1.454.CMB.2.raw
  modified_base (355)..(355): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgaccccaaaagtcctgatctctgccgcctctactttgacaaagtggggtcccatcaggtcagccgcagtgatcgtggacngaattcagtctcacatcagcagcctgcagccctgactatttcgactaacttactacctgaccctaaagtgactaattaaataatcgtaagtttcgggacggtaagggaccgaaaaggggttggaacgaagtaaccgaaaacgtacgtagtacggctaggaactaaccgatctgtaccttactactttccc

SEQ ID NO: 401068 - DNA, 623 bp, Homo sapiens
  misc_feature: GZ8MTXP02JIWCG.15.28.C06.1.454.CMB.2.raw
  modified_base (358)..(358): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaatcctctggattcaccttgagcacttattggatgacttgggtcccgcaggctccgaggggaaggggctggagtgggtggccaccaatacaaaaagntaggaagtgacacaacctatgtagactctgtgatggggcattcaccgtctcctcacgcctccaccaacggcccacgtaccggtccttcccccgtcggccgcccgtcgcctccgacggacgccgacctcccggacgacgccacgacgccggccccgtcgggggcctcggtcccgtcgggttaccgaaaaccggggtaccttaacccgttcccggtaccgtttaacccggttacggaaccgtttcgggaacggtccgggggtcccgg

SEQ ID NO: 401069 - DNA, 574 bp, Homo sapiens
  misc_feature: GZ8MTXP02GR61R.15.28.C06.1.454.CMB.2.raw
  modified_base (264)..(264): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggtgctgttcagcagaacaggaanaccccaaagtcctagatctctcgccgcctcttactttcgacgaaaggttcgggtaccatacgtaaggtacgaggccggacgtagtggactcgtagggacaggaattcagtcctaccacatcagcacgcctcgacacgtcctagacgttatttacgacctaacttactactcgacctaaggtacactaataaataactcgtaacgtttcgggaacggtacggggtaaaccaaggggttaggaaacgtaagtaaccgaaaagtaacgtgtacgcgtacgaacgtacacttcgtattccttactacgttcccg

SEQ ID NO: 401070 - DNA, 523 bp, Homo sapiens
  misc_feature: GZ8MTXP02H1V6U.15.28.C06.1.454.CMB.2.raw
  modified_base (355)..(355): a, c, t, g, unknown or other
  modified_base (424)..(424): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggccagtcagagtattaactaatggtggcctggttcagcagaaccaggaaagaccccaaaagtcctgatctctgccgcctctactttgcaaaaggtgggtcccatctaaggtcagccgcagtggatcgtagggacngtaattcagtctcacatcagcagcctgcagcctgacgtattttgactaaattactacttgacctaagtnacaataataatctagtttacgggagaagggacctaaggtcggaagataacgaaaacggactgtacggctagaacacctatctagttcttacacgttccc

SEQ ID NO: 401071 - DNA, 629 bp, Homo sapiens
  misc_feature: GZ8MTXP02JZTCH.15.28.C06.1.454.CMB.2.raw
  modified_base (198)..(198): a, c, t, g, unknown or other
  modified_base (275)..(275): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttggccgggccagtcagatattactaaatggttggcctggttcagcagaaaccagggaaanaccccaaaagtcctgatctctgccgctctactttgcaaaggtcggggtcccatcgaaggttcagcccggcaggtggactcgtaggggacaggtaacttcagttctaccaccatcagcacgccctgcagcctaggacgtattttgactaacttactactgacctaagtcgactaaattaaataacttactaacgttttaccggggacgggaacggggtaacccgaaaaggggttcgggaaaacggtacgttaaaccggaaaaaccgtaaacgttacgggtacggtaccgtacgggtaaccgtaaccccgtaatttacccgttcggtttaccgttttaccgaaccgttttcccccg

SEQ ID NO: 401072 - DNA, 668 bp, Homo sapiens
  misc_feature: GZ8MTXP02H9048.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggcctcccaggtgaccaaatgtgacatccagatgacccagtcctcccgtccaccctgtctgcatctggtcggagacagagtcaccatcacgttcgccgggcagtcagtagtattaactaagttggttggccttggttcagacaagaaaccgaggaaacgaccccgaaagtcctagatcctctcgcccgccttctacgtttgacgtaaagggttccggggtacccaagtaccgtaaaggttccaagggtcccggaccgtagggtcggacgttcgtaggggaaccagtaaacttcgacgttacctaccgacctataccacgcacgtccctagccacgtccgtagtaacgtttacgtttacgaccttaactttacctacgttaccgaacctaaggttcaactaattaaaactaacgtacgttacggtttcggggaacgggtaacggggtaaacgtaaggggtgaaacgtactaaacgaaaacggtacgtaggtacgtactacgtaaccaccgtattcttacgtacctttcgtacctttccccg

SEQ ID NO: 401073 - DNA, 608 bp, Homo sapiens
  misc_feature: GZ8MTXP02I8PCD.15.28.C06.1.454.CMB.2.raw
  modified_base (250)..(250): a, c, t, g, unknown or other
  modified_base (252)..(252): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatatactaatggtgctgtcngnagaacaggaacacccaaagtctgatctctcgccgcctctactttgacgtaaagggtcgggtacccagtacgtaaggtcaggccggcgaggtcggatcgtaggggacaggtaacttcgacgtcctacaccatccagaccacggccctgaccgacgtcccttagtacgttagttttacgaccttaacctttaacgtaccgttacgacccgtaagtcactaaacttaaataacttacgtacggtttacggggacgggaacgggtaacggtaagggtacggaagtaacgtaaaccgaaaacggtacgtcggtacggtcgtacggaacgtacgtacttcgtcttaccttctacgtttcccg

SEQ ID NO: 401074 - DNA, 631 bp, Homo sapiens
  misc_feature: GZ8MTXP02JKI0Z.15.28.C06.1.454.CMB.2.raw
  modified_base (250)..(250): a, c, t, g, unknown or other
  modified_base (275)..(275): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaagtggtgctgttnagcagaacaggaacacccaaagtcngatctctcgccgcctctactttcgacgtaaaggtcggggtaccagtacgtaaggtcgacggcccggactaggtggacgtcgtaggggactaggtaaacttcgtagtctacacctatcaagcacggcctcgcgacgcctaggacttagtttacgacttaaactttactacgtcgtacctaaggtactactaaattaaagtaacttaccgtaaggtttacggggaaccgggtaacgggtaaaccggtaaaggggtacgggaagtaaacgttaaaccggaaaacgtaacggttgggacggtccgttacggaaccaacccgttagtccgttcgtttacctttaccgtaccgtttcccccg

SEQ ID NO: 401075 - DNA, 641 bp, Homo sapiens
  misc_feature: GZ8MTXP02GA9F2.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctggtcggagacagagtcaccatcacgttggccgggccagtcagtagttattaactaagtggttcgcttggttcagacaagaaaccgaaggaacaccccaaagtcctagatctcgtcgcccgtccttctactttgacgtaaagggtccggggtaccagtacgaggttcaggccgacgaggtgatcggtaggaacagtaatcgacgtcctacacgtatcacgcacgccgtagctacgccgtaggttaacgttacgtttacgaccttaaacgtttaacctctaaccgtaccgtaaagtcgtaacttaaattaaactattacgtaacggtttaccggggaacgggtaacgggtaacgaaaggggtaggaaacgtaaacgtaaacgaaaacggtacgttaggacggtaccgtgtaacccgactacgttactcgtttacttacgtacctttaccccg

SEQ ID NO: 401076 - DNA, 617 bp, Homo sapiens
  misc_feature: GZ8MTXP02HT5RA.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagttattaactaaagtggttggcctggttcagcagaaaccaagggaacaccccaaaagtcctagatctctcgcccgcctctactttgacaaaggtcggggtccatcgaaggttcaggccggcagtggatcgtggggacagtaattcagttcctacaccatcagcacgcctgcacgcctgacgttatttcgactaacttactacgtgacctaagtacgtactaaattaactaagttccttaaggtttccgggaacggggtaacggggtaaaccgtaaagggggttaggaaacggtaaacgttaaaccgaaaacggtaacgtgggttacgggacttacggaaccgaaccctaagtttccgtacgtttcctttaccgttactttcccccg

SEQ ID NO: 401077 - DNA, 523 bp, Homo sapiens
  misc_feature: GZ8MTXP02IAEXR.15.28.C06.1.454.CMB.2.raw
  modified_base (359)..(359): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagacccccaaaagtcctagatctctgccgcctctactttgcaaagtggggtcccatcaaggttcagccggcagtggatctgggacngaatcagtctcacatcagcagctgcagcctgacgattttgacaactttactactgacccaagtgacaattaactaaatctaagtttacggcgggaagggaccgaagggtggaacgagtacaaaacgaactgtacggctgcaccgatcctagtcttcactttccc

SEQ ID NO: 401078 - DNA, 617 bp, Homo sapiens
  misc_feature: GZ8MTXP02H2B1B.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagtagtattaactaaatggttgcctggttcagcagaaacaggaaagaccccaaaagtcctgatctctgccgcctctactttgacaaagtcggggtcccatcgaaggttcagccggcagtggatcgtagggacaggtaattcaggttcctacaccatccagcagccctgcagcctgacgtattttcgactaactttaactactcgaccctaaggtcaccaattaaacttaactactacgttttaccgggacgggtaacggggaacccgtaaaaggggttagggaacgtaaagttaaaccgaaaacgggtaaaccgttggtaacggggtccttacgggaacctaaccccgtaaggttccttaggttactttaccgtaaaccgttttcccccg

SEQ ID NO: 401079 - DNA, 573 bp, Homo sapiens
  misc_feature: GZ8MTXP02JCT4O.15.28.C06.1.454.CMB.2.raw
  modified_base (376)..(376): a, c, t, g, unknown or other
  modified_base (378)..(378): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggtgcctggttcagcagaaaccagggaaagaccccaaaagtcctagatctctgccgcctctactttgacaaagtgggtccatcaagttcagcgtcagtggatcgtgggacagaattcagtctcacatcagcagccngnagctagtacgttatttacacctaacttactactacgacgtaagtacgaactaataaacgttaatacgtaacgtttacgggacgggtaacgggtaacgtaaagggtacggaacgtaactaaacggaaaacggtacgtacgggtacggtacgtacgaaccgtaacgacgttctacgttaccttaccgtactttcccg

SEQ ID NO: 401080 - DNA, 540 bp, Homo sapiens
  misc_feature: GZ8MTXP02JIFSM.15.28.C06.1.454.CMB.2.raw
  modified_base (293)..(293): a, c, t, g, unknown or other
  modified_base (356)..(356): a, c, t, g, unknown or other
  modified_base (422)..(422): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaacaccccaaaagtcctgatcnctgccgctctactttgcaaagtcggggtccagtcaaggttcagccggcagtgatcgtgggacngattcagtctcacatcagcagccctgcagcctgacgtatttgactaacttactactgacccaagtnactaataaataacgtctagtttcgggacggaaggaaccgaagggtacggaaaggtattaaccgaaaaggtaacctggtacggcctaggcaaccattcgtgttccttacactttccccg

SEQ ID NO: 401081 - DNA, 566 bp, Homo sapiens
  misc_feature: GZ8MTXP02F10G0.15.28.C06.1.454.CMB.2.raw
  modified_base (364)..(364): a, c, t, g, unknown or other
  modified_base (369)..(369): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggccttggttcagcagaaaccgagggaaaacgaccccaaaaagtcctagatactctcgccgcctctactttgacaaaaggtcggggtccatcaaggttcaaggccggcagtggattcgnggacngaattcagtctcacatcagcagcctgcacgctgacgtattttgactaacttaactactagaccctaagtgacaataaacttaatactacgtttacgggacgggtaaacggggaccgaaagggttagggacgaagtaacgaaaacgaacgttggtacgcgtacgaacgtacccagtctcgttactacctactttcccc

SEQ ID NO: 401082 - DNA, 563 bp, Homo sapiens
  misc_feature: GZ8MTXP02GO2WZ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaacaggaaagaccccaaaagtcctagatctctcgccgcctctactttgacaaaggtcggggtacccatacaaggttcaggccgcagtggatcgtaggggacagaacttcagtctacaccatcagcacgcctgcacgcctgacgtattttcgactaacttactactagacctaagtcactaataaattaatctaagtttcgggacgggtacgggaaccgaaagggttacggagaaacgtaacaaaacggacgtagtacggctacggaaccaccgtaattcctgtaccttactaactttccccg

SEQ ID NO: 401083 - DNA, 599 bp, Homo sapiens
  misc_feature: GZ8MTXP02HYSBA.15.28.C06.1.454.CMB.2.raw
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttatggatgacttaggtccgccaggctccgaggggaaggggcgtgggaggtggggtcggccaaccataaacgaaaaaagagtaggaagtgaaccacaaacctatgtagactctgtgagtgggcgattccaccgtctcctcacgccctacccaccgaccgggccctacgtcccggtccttcccccgtcggcccgaccctcgtcctacccgagggaccgcgacccgtcgagacgacaccgacgcccggcccgtcggctcgccgtacggtcgaacggtcctacgtccgcgtacgtacgacgtacgacggtcggcg

SEQ ID NO: 401084 - DNA, 576 bp, Homo sapiens
  misc_feature: GZ8MTXP02GKJRA.15.28.C06.1.454.CMB.2.raw
  modified_base (199)..(199): a, c, t, g, unknown or other
  modified_base (253)..(253): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatcgacccagtctccgtccaccctgtctgcatctgtcgganacagatcacatcacttgccggccagtcagatattactaatggttgctgttcagnagaacaggaaacacccaaaagtcctagatctctcgccgtcctactactttcgactaaacgggtcgggtacccatcgaaggttcagcccgcagtagatcgtaggacagtactcgacgtctacaccatcagcacgctgactagctagacgttatttcgacttaacttactactacgtacctaaagtacaactaaattaaacgtaattacctagtttacgggacgggtaaacgggaccgaaagggtacggaaagtactaaacgaaacggtacgtcggtacggctacggaacctactaacttcgtacttaccttactacctttcccg

SEQ ID NO: 401085 - DNA, 573 bp, Homo sapiens
  misc_feature: GZ8MTXP02ICRYL.15.28.C06.1.454.CMB.2.raw
  modified_base (197)..(197): a, c, t, g, unknown or other
  modified_base (347)..(347): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtattactaatggttggctggttcagcagaaaccgaggaaacgaccccaaaagtcctagatctctcgcccgcctctactttgactaaaggtcgggtcccatcaaggtcagccgcagtgntcgtgggacagtattcagtctcacatcagcacgctgcagcctagacgtattttcgactaacttactactcgacctaagtgactaataaacttaagtactagtttacggggacggtaacgggaaccgaaagggttacggaaagtactaaccgaaaaacgtaaccgtgggtaacgtctacggaacctaaccgtaactttccgttacgttcctttacgtactttccccg

SEQ ID NO: 401086 - DNA, 620 bp, Homo sapiens
  misc_feature: GZ8MTXP02HZ056.15.28.C06.1.454.CMB.2.raw
  modified_base (370)..(370): a, c, t, g, unknown or other
  modified_base (399)..(399): a, c, t, g, unknown or other
  modified_base (482)..(482): a, c, t, g, unknown or other
  modified_base (515)..(515): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagctacttattggatgacgttgggtccgccgaggcctccgaaggggaaggggctggaggtggggtcgccaaccaataaacaaaaaagngtaggaagtagaaccaacaaactatgtanactctgtgagtggggccctattcccaccgtctccctcacgccctaccaaccgaaacgggcccaagtcccggtccttcccccgngggccctccctggccctcccgaaaggggacccncccgaccgtacgacgacgaccacgcggtcccggccgtggcctacgccgtacggacgtaacgtaccttaccgtccgtacgtaacgacgacgtacggacggcggtcg

SEQ ID NO: 401087 - DNA, 557 bp, Homo sapiens
  misc_feature: GZ8MTXP02IESMY.15.28.C06.1.454.CMB.2.raw
  modified_base (392)..(392): a, c, t, g, unknown or other
  modified_base (399)..(399): a, c, t, g, unknown or other
  modified_base (417)..(417): a, c, t, g, unknown or other
  modified_base (542)..(542): a, c, t, g, unknown or other
  modified_base (547)..(557): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgacaaatgaacaacctgagagccgaggacacggctgtgtattactgtgtgagagatgttctgcgttggggccagggaccctggtccaccgtctcctccacgccctccaccgaagggccccagtccggtccttcccccgngggcccnccccctgcctccgaggancccacctccgagacgcacgacggcccggccctggggctcggcccgtgggtaccaagggtaccttaccgtttcccgcgttaccgtagaccgtagcggcggggctgggacgaacgggccgacgtaanacgcnnnnnnnnnnn

SEQ ID NO: 401088 - DNA, 643 bp, Homo sapiens
  misc_feature: GZ8MTXP02HEVK9.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaagtggttgctggttcagcagaacaggaacacccaaaagtcctagatactcgtcgccgtcctactacgtttcgacgtaaaacggtcggggtacccagtacgtaaggttcgaggccccggacgtacggtaggacttccggtaggggaacctaggtaaactttcgaacgttacctacgtaaccaagttccaaacgtcaaccgtcccgtaggaccaacggtccttaggaaccttagttttacggaccctaaactttacgtaccgttacgaccgtaagttcgaactaaattaaactaattcgtaacggtttcggaacgggtacggtaaacgagggtagtaacgattaacgaaaacgtcgtaggacgtacgtacgaacctaaccgagttcgtacttacttacaacctttcccg

SEQ ID NO: 401089 - DNA, 562 bp, Homo sapiens
  misc_feature: GZ8MTXP02HKLCR.15.28.C06.1.454.CMB.2.raw
  modified_base (448)..(448): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacgttgccgggcagtcagagtattactaatggtgctgttcagcagaacaggaaacaccccaaagtcctagatctctcgccgcctactactttgactaaaggtcggggtacccagtacgaaggttcaggcccggacgagtggatcgtgggacagtaacttcagtcctaccaccgatccagcacgcctgcgagcctagtacgtatttcgacctaacgtttactacgtcgacctaagtnactaattaaataactcgtaagttcgggacggtacgggaacgtaagggtagaagataaacgaaacgtacgtaggtcgactacgaaccgactagttctagttcctctacttccccg

SEQ ID NO: 401090 - DNA, 624 bp, Homo sapiens
  misc_feature: GZ8MTXP02H47WD.15.28.C06.1.454.CMB.2.raw
  modified_base (200)..(200): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctggtcgganacagagtcaccatcacttgccgggccagtcagagtattactaaatggttgcctggttcagcaagaaaccaggaaacaccccaaaagtcctagatctctgccgccctctactttgacaaaggtcgggtccatcaaggtcagtccggcagtggatcgtaggggaacagtaaattcgaacgttcctacaccatcaagcacgcctgaccaggtaccctgtacgttatttcgacctaacttaactacttacgacctaaagtcactaattaaaatactacgttacgttacggggaacgggtaacgggaaacccgtaaaggggtacggaaagtaaactaaccgaaaaacgggtaacctggtaacgggtcttacggaaacccgtacccgtaaacttcccgttcggttaccctttaccaaaccgtttcccccg

SEQ ID NO: 401091 - DNA, 598 bp, Homo sapiens
  misc_feature: GZ8MTXP02F5IBK.15.28.C06.1.454.CMB.2.raw
  modified_base (252)..(252): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggttgctgttcngcagaacgaggaacgacccaaagtcctagatctctcgccgcctctactttgacgaaacggtcggggtaccccataccgaaaggttccgaaggcccgggcaaggttgggaattccgtaggggaacaggtaaacttcaacgtcctcaaccatcagcgagccctgcacgtcctagtaaccgttatttttacgacctaaactttacctaactgaccaaagtcactaaattaaataagttacgtaacgtttcggggaaccgggaaggggtacccgaaagggtaggaaagtataaccgaaaacggaccgtgtacgggctagaaccacctatctcgtctttacactttacccg

SEQ ID NO: 401092 - DNA, 538 bp, Homo sapiens
  misc_feature: GZ8MTXP02JJ4B4.15.28.C06.1.454.CMB.2.raw
  modified_base (349)..(349): a, c, t, g, unknown or other
  modified_base (423)..(423): a, c, t, g, unknown or other
  modified_base (472)..(472): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagcgtgggtttcctgtgctatttagaaggtgtccagtgtgaggtgcaactggtggagtctgggggaggcctcgtccaggccgggggggtccctgagactctcctgtgaagcctctggattcaccttgagcacttattggatgacttgggtccgcaggctccgaggggaaggggctggagtgggtggccaccataacaaaaagntaggaagtgaccacaacctatgtgaactctgtgatggggccattcaccgtctccagagacgacgaccaagaacncactacatctgacaaatgaaacaaccgtgagagccgaggacaggctgtntatatgtgtgagagactgttctggacggttggggccgtacgggacccgtggtccaaccggtctccc

SEQ ID NO: 401093 - DNA, 570 bp, Homo sapiens
  misc_feature: GZ8MTXP02GTV5Z.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaatggtggctggttcagcagaaccaggaaacgaccccaaaagtcctagatctctgcccgcctctactttgacaaagtcggggtccatcgaaggttcagccggcagtgatcgtgggacaggaattcagtcctcacatcagcagcctgcagcctgacgtatttcgactaacttactactgacctaagtcgacaataaataatactagtttacgggacgggtaacgggtaaccgaaggggttacggaagtaacgtaacgtaaaaacggaacgtaggtacgggaccttacggaacctaaccgtactacgttcggttacctttacgtaactttcccccg

SEQ ID NO: 401094 - DNA, 584 bp, Homo sapiens
  misc_feature: GZ8MTXP02GNAMM.15.28.C06.1.454.CMB.2.raw
  modified_base (356)..(356): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaagtggggtccatcaaggtcagccggcagtggatcgtgggacngaattcagtctcacatcagcagccctgcagcctgacgtattttacgactaactttactaacttgaccctaaaggtcacaattaaataactacgtaagtttcggggacggaaggggaaccctaaaggggtacggaaagtaaataccgaaaaacggaacgttacggtacgggacttacgggaaccgtaaccccgtaatttccggtgttacctttactaacttttcccccg

SEQ ID NO: 401095 - DNA, 626 bp, Homo sapiens
  misc_feature: GZ8MTXP02H7ZZV.15.28.C06.1.454.CMB.2.raw
  modified_base (259)..(259): a, c, t, g, unknown or other
tcagtctacgtagccacgaccggtgctcgatttagagctcacgtattgggtttggggggagtcagactcagtcaggacacagcatggacatgagggtcccccgctcagctcctggggctcctgctgctctggctcccaggtgccaaatgtgacatccagatgacccagtctcccgtccacctgtctgcatctggtcggagacagagtcaccatcacgttcggccgggcagtcagtagtattactaagtggtgctggttnagcagaacaggaacgaccaaagtctagatctctcgccgcctactactttgacgtaaagggtcggggtacccatacgtaaaggttcgaggcccggacgtaggtaggacttcggtaggggaactaggtaactttcgacgttccacctaccaatcgacgacagtcccgtgaccagtcctaggacgttatttcgacttaacttacctactacgaccgtaagtcactaattaaataactacgttacgttcgggaacgggtaaggggtaaccgtaaaggggtacggaaagttaacaacgaaaaaccgtcgttaggtcggtactacgtaaccaacgtacgttcgttacgttacctttacgtaccgtttcccccg

SEQ ID NO: 401096 - DNA, 709 bp, Homo sapiens
  misc_feature: GZ8MTXP02IKOE9.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtccaccatcacttgcccgggccagtcagagtattaactaaagtggttggccttggttcagacaagaaaccgaagggaaacgaccccaaaagtcctagactctctcgcccgtccttcttacgtttagaccgtaaaacgggttccggggtacccagtaccgtaaggttcgacggcccggacaggtggagtcgtagggaacagtaacttcagttcctccaacatcgacgcacgccctgaccacgtcctaggtaacgttacttttacgaccttaaaccttaccttaaccgtacgtaaccgtaaagttcgtaactaaacttaaaagttaacttacgttaacggtttaccggggaacgggggtaacggggtaaaccggtaaaaggggtacgggtaaacgaaacggtaaaccgtaaaaaccgggtaacgttacgggttacgggtaccgttacgaacccgtaaccttaacgttccggtttaacgttccctttaaccgtaccctttacccccgg

SEQ ID NO: 401097 - DNA, 555 bp, Homo sapiens
  misc_feature: GZ8MTXP02FV4OV.15.28.C06.1.454.CMB.2.raw
  modified_base (254)..(254): a, c, t, g, unknown or other
  modified_base (449)..(449): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttgctgttcagnagaacgaggaaacgaccccaaaagtcctagatctctcgcccgtcctcttactttgactaaagggtcggggtacccagtccgaaggttcaggcccggacaggtggattcgagggaacaggtaaattcgagtcctcaacctatcagcagcctgacagcctgactattttacgactaacttactactcgacctaagtnactaaataataatactagttacgggacggaagggaaccgaagggtagaagaactaacgaaaacgacgtgtacggctagaaccacgtatcgtatctactacttcccg

SEQ ID NO: 401098 - DNA, 598 bp, Homo sapiens
  misc_feature: GZ8MTXP02HXG3M.15.28.C06.1.454.CMB.2.raw
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttggccgggccagtcagagtatactaatggtggctgttcagcagaacagggaacaccccaaagtccagatctctcgccgtcctactactttgacgtaaacggtcggggtaccagtacgtaaaggttcaggtccgcgaggtggacttcgtagggacaggtaacttcagtcctacacatcagcacgctgcagtctgacgtatttacgactaacttactacgtacgtacctaagtcgaactaataaactacttacgttacggtttaccggggaacgggtaacgggggtaaaccgaagggggttacggaaaggtaactaacggaaaaccgtaagttcggtacggctacgaaccgtactactcgttgttaccttctacgtttccccc

SEQ ID NO: 401099 - DNA, 600 bp, Homo sapiens
  misc_feature: GZ8MTXP02FNK3L.15.28.C06.1.454.CMB.2.raw
  modified_base (356)..(356): a, c, t, g, unknown or other
  modified_base (361)..(361): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacaccccaaaagtcctagatctctcgcccgcctctactttgacaaagtcggggtcccatcaaggttcagccggcagtgatcgnggacngaatcagtctcacatcagcagcctgcagcctgtacgtattttcgactaacttacctacgtgacctaagtcgactaattaaattaacttacctagtttaccggggacgggtaacggggaaccgtaaaggggttacggaaagtacgttaaaccgaaaaacggttaccgtagggttacgaccgttacggaacccgtaacctaacgttccttaacggttcctttaccgtaacgttttcccccg

SEQ ID NO: 401100 - DNA, 597 bp, Homo sapiens
  misc_feature: GZ8MTXP02FRYLS.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccgggccagtcagagtattactaatggttgctggttcagcagaacaggaaacaccccaaaagtcctagatctctcgccgcctcttactttgacgtaaaaggtcggggtaccctatacgaaggttacaggccggactaggtaggacgttacgtacggggactaggtaacttcgagttcctacaacctatcagcaacgccctgacacgcccgtagtaacgttagttttcgactaacctttactacttcgacccgtaagtacgtactaaattaaactaacttactaacggtttcgggacggtaacgggaacgtaaggtggaaagtacgtaacgaaaacgtacgtggtacggctacgctacctattcctgttcctctacgtttccc

SEQ ID NO: 401101 - DNA, 606 bp, Homo sapiens
  misc_feature: GZ8MTXP02JM5ZP.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttggccgggccagtcagagttatactaagtggttgcctggttcagcagaacgaggaacgacccaaagtcctagatctctcgccgcctctacgtttcgacgtaaggtcgggtaccagtacgaaggttcaggccggctaggtgatcgtaggaacagtaacttcgacgtcctacacccatccagcacgcctgacacgactgtacttacgtttacgacttaaccttactacgtacgacctaaggtactaacctaattaaactaacttacgttacggtttaccggggacgggtaacggggtaaaccgaaggggttagaacgaacgtaaacgaaaacggtaacgtcggtacggactacgaaccgactacgtacctcgttaccttctaactttccccg

SEQ ID NO: 401102 - DNA, 604 bp, Homo sapiens
  misc_feature: GZ8MTXP02FZ9DE.15.28.C06.1.454.CMB.2.raw
tcagtctacgtagccacgaccggtgctcgatttagagctcacgtattgggtttgggggagtcagactcagtcaggacacagcatggacatgagggtcccgctcagctcctggggctcctgctgctctggctcccaggtgccaaatgtgacatccagatgacccagtctccgtccaccctgtctgcatctggtcggagacagagtcaccatcacttcgccggccagtcagagtattactaagtggttgcctggttcagcaagaaccgaaggaaacgaccccaaaagtcctgatctctcgcccgcttctactttgacaaaggtcggggtaccatacgaaggtcacggccggcaggtaggactcgtacggggacaggtaactcgacgtcctaccaacatacagcacgtccgtgcacgtcctacgtaacgttattttcgaacctaacgtttactactggacctaagtacactaattaaataacttacgtacgtttacggggacggggaaacgggtaaccggaaaggttaggagtaaataccgtaaaacgaacgtcgtacggcgtcgaaccgtacctacgttactccggtttactcctactttcccccg

SEQ ID NO: 401103 - DNA, 788 bp, Homo sapiens
  misc_feature: GZ8MTXP02FXS5M.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagagtcaccatcacttgccgggcagtcagagtattactaatggttgctggttcagcagaaacgaggaaacgaccccaaaagtcctagatctccgtcgcccgtcctaccttacgtttacgtaccgtaaaacgggttcggggtaccctaaacgttaccgtaaaaggggtttcgaacgggtccccggacgtaacggtaggggtaacttccggttaagggggaactagggtaaactttacgtaacggttacctccaaaccctaaatccgaagaccgaaccggtccttacgggccaacgggtaccccttggggaaaccttacgttttttcggaaacccttaaaccgttttaaacctaaccttacggaaacccccgttaaaggggtttacgaaccgttaaaactttaaaaagttaacctttaccgtaacggtttttacccgggggacggggtaaaacgggggaaaaccggttaaaaggggttacggggaaaataaacgttaaaccgaaaaaaccggtaagttaccgggttaaggccttacggaaccaaacccgtaattaccgttcggtttactttaccgtactttcccccgg

SEQ ID NO: 401104 - DNA, 641 bp, Homo sapiens
  misc_feature: GZ8MTXP02FN3EU.15.28.C06.1.454.CMB.2.raw
  modified_base (292)..(292): a, c, t, g, unknown or other
  modified_base (343)..(343): a, c, t, g, unknown or other
tcagtctacgtagccacgaccggtgctcgatttagagctcacgtattgggtttggggggaagaggaagactgaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctcgtggattcaccttgagctacttattggatgacgttgggccnccaggcctccgaggggaggggctggagtgggtcggccaccataacaaaagntaggaagtgacacaaacctatgtagaacctctgtgagtcggggcctattccgaccgtctccagacgacgacgaccaaagactacactacatctagacaaatacgaaacctaaacctgaacgacggacccggaagggaccgacgggacttaggtacgttatttacgtggttaggtaggaagtagtagttcgtttcggtggtacggggttcgggggacccggtacggggtaacccctcggggtacccaacccggttcctcccgtacgtaccgaccccgtacccgaacccggtaacccggg

SEQ ID NO: 401105 - DNA, 543 bp, Homo sapiens
  misc_feature: GZ8MTXP02F3VBT.15.28.C06.1.454.CMB.2.raw
  modified_base (272)..(272): a, c, t, g, unknown or other
  modified_base (284)..(284): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacaggaaanccccaaaagtcngatctctgccgctctactttgcaaaagtggggtcccatcaaggttcagccggcagtggatcgtaggacagaattcaagtctcaccatcagcagcctgcagcctgacgtattttgactaacttactactgaccaaagtgacaaataaactaatactaatttcgggacggtaacgggaccgaagggtaggaaggacttacgaaaacgtaaccgtgtacggacttacggaacaacctatacgtcgttcttacactttccccg

SEQ ID NO: 401106 - DNA, 625 bp, Homo sapiens
  misc_feature: GZ8MTXP02JN7AU.15.28.C06.1.454.CMB.2.raw
  modified_base (412)..(412): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttggcccggcagtcagagtattactaatggttggcctggttcagacagaaaccgaggaaacgaccccaaagtcctagatctcgtcgccgccttctactttgacgtaaaggtcggggtcccagtacgtaaggttcacggccggacaggtgactcgtagggacaggtaacttcagtcctacaacatacgagcacgtccngactcgcgtacgtacgttattttacgacctaactttacgtacttacgaccgtaagtcgtaactaataaacttacgtacgttaacggtttcggggacgggtaacgggtaaccgtaaaggggtaggaaacgtaacgtaaacggtaaaacgtacgttcgaacggtcctacggaaccgtaaccctattcggttacgttccttacctacggtttcccc

SEQ ID NO: 401107 - DNA, 730 bp, Homo sapiens
  misc_feature: GZ8MTXP02IQ780.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctggtcggagacagacgtcaccatccacgttcggcccgggcagtcagtagtattactaaagtggttcggcttggttcagacaagaaaccgagggaaacaccccgaaagtcctagatctctcgccgtcctacttactttgacgtaaagggtcgggtaccagtacgtaggtcgacggccggtacgtaggtggacgtcgtaggaacagtaattcgacgttcctaccacctatcacgtcgacgtcctagcgtacgtcgtacggtacgtttacgttttaccgacttaaaccgtttacctacgttaccgtaacccgtaaaggttaccgtaacttaaaactttaaaacgttaaacgtttaccgttaaacggttttaacccgggggaaccgggggttaaacggggtaaaacccggtaaagggggttacgggaaaacgttaaaccggttaaaccgtaaaaaccggtacggttacgggttacggtaccgttaccggaaccttaaccgtactttaccgttacgtttacctttaccgttaacctttcccccg

SEQ ID NO: 401108 - DNA, 779 bp, Homo sapiens
  misc_feature: GZ8MTXP02FWMAV.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacgttggccgggccagtcagagtattaactaaagtggttgctgttcagcaagaaaccgaggaaacaccccaaaagtcctagactctctcgcccgtccttacttacgtttacgacgtaaaacgggttccggggtaccctaagtacgtaaacggttcgaacggtccccgggacgtagggtagggtaacgttcggtaacggggtaaactaggtaaactttaccgtaaacggttacccttaaccgaacccgtaaacttcccgaaacgcccgaaccggtccccgttacggacccgtaacccggtacccgttaacggtaaaccggtttaacgtttttacccggaaacctttaaaaccctttaaaccgttaaacccgttacggtaaaccccggttaaagggttaccgtaaaccttaaaatttaaaacttaaacgttaccgttaacgggtttaccggggaccggggtaaacgggtaaccggtaaagggtacggaaagtaacgttaaacgaaaaccggtagtcggtacggtactacgaaccacgtacttaccgtcgttcctactacctttccccg

SEQ ID NO: 401109 - DNA, 571 bp, Homo sapiens
  misc_feature: GZ8MTXP02GEER3.15.28.C06.1.454.CMB.2.raw
  modified_base (175)..(175): a, c, t, g, unknown or other
  modified_base (279)..(279): a, c, t, g, unknown or other
  modified_base (313)..(313): a, c, t, g, unknown or other
  modified_base (320)..(320): a, c, t, g, unknown or other
  modified_base (558)..(562): a, c, t, g, unknown or other
  modified_base (564)..(571): a, c, t, g, unknown or other
tcagtctacgtagccacgaccggtgctcgatttagagctcacgtattggggtttggggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggccgattcaccgtctccagagacgacgccaaagaactcaactacatctgacaaatgaaacaacctgagngccgagacacggctgtgtattactgtgtgagagnttgttcnggtcggttcggggccgacggggaacccgttggtccaccgtcctcctcacgccctaccaccgaacgggccctagtcccggtccttcccccgtggcctccccgtgcctacccgacggcgaccacccgtccggacgacgccacgacgccggcccgtcggcgtcgccgtggtaccgaacggtaccttaccgtccgaccgttacgtagacgtaggacggcgggcgtggacgaggcacgagagnnnnngnnnnnnnn

SEQ ID NO: 401110 - DNA, 628 bp, Homo sapiens
  misc_feature: GZ8MTXP02G63IA.15.28.C06.1.454.CMB.2.raw
  modified_base (199)..(199): a, c, t, g, unknown or other
  modified_base (424)..(424): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcgganacagacgtcaccatcacgttcggccggccagtcagagttattactaagtggtgccttgttcagacaacgaaacgaggaacacccaaagtccagatctctcgccgtccttctacgttgacgtaaagggtccgggtacctagtacgtaaggttcgacggccggacgtaggtggacgtacgtagggaacagtaacttcgacgtcctacactactacgacgcacgtccncgacacgtcctagacttacgtttacaccttaaacttacgctacgaaccgtaagctaactaaattaaactacgtacgttacggttacgggaacgggtaacggtaaccgtaaggggtacgtaacgtaactaaaacggaaacgtaacgtcggtacggtactacgaaccgtactaacgttctacgtttcttacctaaccgtttccccg

SEQ ID NO: 401111 - DNA, 525 bp, Homo sapiens
  misc_feature: GZ8MTXP02JHNC5.15.28.C06.1.454.CMB.2.raw
  modified_base (356)..(356): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaaccagggaaagacccccaaaagtcctagatctctgccgcctctactttgcaaaagtggggtcccatcaaggttcagccggcagtgatcgtgggacngaattcagtctcacatcagcagcctgcagcctgacgtatttgctaacttactactgaccaaagtgacaataataatacagtttacggacggagggaccaaaggttcgggaatagtacgaaaagtaactgtacggcttcggaacaccgtatctagtccttacacttcccg

SEQ ID NO: 401112 - DNA, 585 bp, Homo sapiens
  misc_feature: GZ8MTXP02IVXLN.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccggccagtcagagtattactaagtggttggccttggttcagacaagaaaccgagggaaacgaccccaaaagtcctagatctctcgcccgccttctactttgactaaaaggtcggggtacccagtacgaaggttcaggcccggacgagtggatcgtagggacagtaattcagtctaccacatcagcacgcctgcacgccgtgtaacgttatttacgaccttaaacgttacctacttacgacctaaaggttcactaaattaaagtaattacgtacgttcgggacggaacgggtaacgaagggtaggagtacgtaaacgaaaacgtacgtggtacgctagccactactctacgtacttactacttccccg

SEQ ID NO: 401113 - DNA, 548 bp, Homo sapiens
  misc_feature: GZ8MTXP02HRJK5.15.28.C06.1.454.CMB.2.raw
  modified_base (233)..(233): a, c, t, g, unknown or other
  modified_base (249)..(249): a, c, t, g, unknown or other
  modified_base (260)..(260): a, c, t, g, unknown or other
  modified_base (269)..(269): a, c, t, g, unknown or other
  modified_base (279)..(279): a, c, t, g, unknown or other
  modified_base (282)..(282): a, c, t, g, unknown or other
  modified_base (438)..(438): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctccaggtgccaaatgtgacatcagatgacccagtctccgtccacctgtctgcatctgtcggagacagagtcaccatcacttgccggcagtcagtagtatanaagtggtgctgtcagnagaacaggaanccaaagtcngatctctgcnctntactttgacaaaggtcgggtacccagtacgaaacggttcgaagccggacaggtcggaatcgtaggggacaggtaaacttcacgttctacaaccatccaagcaagccctgcagcctgaacgtatttacgactaaacttacacttagaccaaggttanactaataaataatacgtacgtacggacggaacgggaacgaaggtacggagaacgtaaacgaaacgtaacgtacgtcgacgtacgaacgactactctctactactactccg

SEQ ID NO: 401114 - DNA, 719 bp, Homo sapiens
  misc_feature: GZ8MTXP02JF4IJ.15.28.C06.1.454.CMB.2.raw
  modified_base (709)..(709): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcacttggccggcagtcagtagtattaactaagtggttgcctggttcagcagaaaccgaggaaacacccgaaagtcctagatctctcgccgcctactacgtttgaccgtaaagggtcgggtacccagtacgtaacggttcacggcccggacgtaggtacggtacgtcggttaggggaaactaggtaaacttcgtaacggttcctaccaaacccgtatccgaacgaccgaaacgtcccgtacggaccgaaccgtcccgttacggtaacgtttaacgtttttacgacccgtttaaaaccttttaaccgtaaccgttacggtaaccccgtaaagggttacgtaacctaaaagtttaaaacttaaacgttaccgttaacggtttaaccggggaacggggttaaaccgggggacgtaaacgggggtagaaacggtaaacgtaaacccgaaaacgtaccgttgggacggtactacggaaccgtaacacgttacgtcgttacccttntacctttccg

SEQ ID NO: 401115 - DNA, 504 bp, Homo sapiens
  misc_feature: GZ8MTXP02FIZ9U.15.28.C06.1.454.CMB.2.raw
  modified_base (359)..(359): a, c, t, g, unknown or other
  modified_base (425)..(425): a, c, t, g, unknown or other
  modified_base (436)..(436): a, c, t, g, unknown or other
  modified_base (444)..(444): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaaagtcctgatctctgccgcctctacttttgcaaaagtggggtcccatcaaggttcagccggcagtggatctggggacngaaattcagtctcaccatcagcagcctgcagccctgacgattttgacaacttactactgccaagtnacataataatnatttcggngtagggaccaaggtggagagtacaaacgaactagtgctagcaccatctgtcttcattccc

SEQ ID NO: 401116 - DNA, 545 bp, Homo sapiens
  misc_feature: GZ8MTXP02I2DS7.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagagtatactaatggtgctggttcagcagaacaggaaacaccccaaagtcctgatctctcgccgtcctctactttgacgtaaaggtcggggtacccagtcgtaaggttcaggcccggcaggtggatcgtagggacagtacttcgagtcctcacatcagcacgcctgcagcctagacgtatttcgactaacttactacgtcgacctaagtcataataataatctagtttcggacggtaaggaccgtaagggtcggaagtactaacgaaaacgagtcgtacggctaggaacacgtactcgtcgtacttactacgtttcccg

SEQ ID NO: 401117 - DNA, 601 bp, Homo sapiens
  misc_feature: GZ8MTXP02IFF7I.15.28.C06.1.454.CMB.2.raw
  modified_base (254)..(254): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctggtcggagacagagtcaccatcacttggccggccagtcagatatactaagtggtgctgttcagnagaaacaggaaacacccaaaagtcctgatctctcgccgtcctctactttgactaaggtcgggtccatacgaaggttcgagccggacaggtggactcgtaggggacagtaattcacgttcctaccactatccagcaacgcccgtgccgtacgtccgtaggtacgttaacgtttcgaaccttaaactttacctaacgtcgaccgtaaaggtactactaaataaaattaactacgttaaagtttcggggaacggggtaacgggaaccgtaagggtaggaaacggataaacgaaaacggtaacgtagtcggtactagaaccgtactacttctgtttccttactacttcccg

SEQ ID NO: 401118 - DNA, 783 bp, Homo sapiens
  misc_feature: GZ8MTXP02IY13O.15.28.C06.1.454.CMB.2.raw
  modified_base (199)..(199): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctcccgtccaccctgtctgcatctgtcgganacagagtcaccatcacgttcggcccggcagtcagtagtattaactaagtggttgcttggttcagacaagaaacgaggaaacaccccaaagtcctacgcttctcgtcgcccgtccttactactttacggacgtaaacgggttcgggtaccctagtacgtaaggttcacggccgcgaggtggtaacttcggtacgggaactaggtaaactttccgaacggttccctaccgaacctattacccgacgggacctaacccggtcccgttacggacccgtaaccggtacccgttacggggttaaaccgttttacgtttttaaccggaaacccgtttaaccttttaaaccttacccgtttaccggaaccccggttaaagttacccggtaataaaacctttaaaattaacgtttaccgttaacgggtttaccgggggaaccggggtaaacggggtaaaaccgtaagggggttaaggaacggtaaactaaacccggttaaaaggaacgtttcgggtacggtaccgttaccgaaccggttaaacccttcggtttaaccgttccgtttacttacctttaacccggttttcccccg

SEQ ID NO: 401119 - DNA, 640 bp, Homo sapiens
  misc_feature: GZ8MTXP02HY06T.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagagtcaccatcacttgccggcagtcagtagtattactaagtggttggcctggttcagcagaaacaggaaacgaccccaaaagtcctagatctctcgcccgcctactacgtttgacgtaaaggtcggggtacccagtacgtaaggttcaggccggcaggtggactcgtaggggacaggtaattcagttcctacacatcagcagctgcagtcctgacgtatttgactaacgttactactgaccctaagtcgactaacgtaaattaactacgttaagtttaccggggacgggaacggggtaaccgtaaaggggttcgggaaaacgtacgttaaaaccgaaaaccgggtaaacgttacggggtacggtacccgttacggaacccttaacccgtaaacgtttccttacggtttaccctttaccgttaaccttttaccccccg

SEQ ID NO: 401120 - DNA, 638 bp, Homo sapiens
  misc_feature: GZ8MTXP02HRAMO.15.28.C06.1.454.CMB.2.raw
  modified_base (198)..(198): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagagtcacatcacgttgccgggcagtcagtagtatactaagtggtgctgtcagcagaacgaggaacaccaaagtctagactctctcgccgtcctacttactttcgacgtaaagggtcgggtaccagtacgtaaggtcgaggccggacgtagtggagtcggtagggaacgtagtacttacgtacgtacctaccacactacgagaccgacgtccgacgcgacgtcgtacgtacgttacgtttacgtaccttaacttactacgtacgtaacgttaagtacgtaactaaattaaacttaacgttacgtacggtttacgggacgggtaacgggaacggtaaagggtacggaaacggtacgtaaacgaaacggtaacgtacgggtacgtacgtacgtaaccgtactaacgttcgttacgtttccttaccgtttaaccttccccg

SEQ ID NO: 401121 - DNA, 585 bp, Homo sapiens
  misc_feature: GZ8MTXP02F8S30.15.28.C06.1.454.CMB.2.raw
  modified_base (291)..(291): a, c, t, g, unknown or other
  modified_base (338)..(338): a, c, t, g, unknown or other
  modified_base (361)..(361): a, c, t, g, unknown or other
tcagtctacgtagccacgaccggtgctcgatttagagctcacgtattgggtttgggggaagaggaagactgaaggcctttccacttggtgatcagcactgagcacagaggactcaccatggaattggggctgagcttgggttttccttgttgcttattttagaaggtgtccagtgtgaggtgcaactggtggagtcgtgggggaggcctcgtccgaggccggggggtccctgagactctcctgtgagcctctggattcaccttgagctacttattggatgacttgggtccnccaggcctccgaggggagggctggagtggtgccaccataacaaaagntaggaagtgacacaactatgtanaacctctgtgatcggggcctattccaccgtctaccgagacgaccgacgaccaaaacgaactccactaacatctagacaaatacgaaactaacctgaaacgacgaccgaggacgacggtcgtgtagtattacgtgtagtgagtagagttgtcgtgcgggttcgggaccgacgggtaaccctggtaccaaccgtcctacctcgaccgccctacccgacgaacccgg

SEQ ID NO: 401122 - DNA, 600 bp, Homo sapiens
  misc_feature: GZ8MTXP02G1GQY.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaagtggttgctgttcagcagaaccaggaaacaccccaaaagtcctagatctctcgccgcctactactttgactaaacggtcggggtacccatacgtaaggttcaggccgcagtgatcgtgggacagattcagtctacacatcagctagccgtgcacgccgtagaacgttatttacgacctaactttacctacgtacgaccgtaagtgacctaattaaactaacttacgtacgtttacgggacgggtaacggggaacgtaagggtacggaagtaacgttaaccgaaaacgtaacgtcggtaacggtcttaaacggccgtaacccgtaagttacccttggttaccctttacgtaccgtttcccccg

SEQ ID NO: 401123 - DNA, 610 bp, Homo sapiens
  misc_feature: GZ8MTXP02GCW91.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggttgcctggttcagcagaaaccagggaaacgaccccaaaagtcctgatctctgcccgtctctactttgcaaagtcggggtccatcaaggttcagccggcagtggatcgtgggacagaattcagtctcaccatcagcagcctagcagcctgacgtatttcgactaacgttactacgtgacctaagtcgactaaattaaactaactacgtaacgtttaccggggacgggtaacgggggaaacccgtaaaggggttagggaacgtaacgtaaaccggtaaaaaccggtaaacgtttcgggtacgggtaccgttacgggaacctaaacccgtacttaccgttcggtttaccttaccgttaacttttcccccg

SEQ ID NO: 401124 - DNA, 523 bp, Homo sapiens
  misc_feature: GZ8MTXP02FZALM.15.28.C06.1.454.CMB.2.raw
  modified_base (268)..(268): a, c, t, g, unknown or other
  modified_base (286)..(286): a, c, t, g, unknown or other
  modified_base (343)..(343): a, c, t, g, unknown or other
  modified_base (414)..(414): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttgctggttcagcagaacaggaaanacccaaaagtcctgatcnctgccgctctactttgacaaagtcgggccatcaagtcagccgcagtgatcgtggacngaattcagtctcacatcagcagcctgcagtcctgacgtatttcgactaactttaactactcgacctaagtnacaattaaactaatactagtttcggggacggtaacgggaacgaaggggtcgaaagataacgaaaacgaacgtcgtacggctacgaacgactatctgttctctacttccc

SEQ ID NO: 401125 - DNA, 609 bp, Homo sapiens
  misc_feature: GZ8MTXP02F9B02.15.28.C06.1.454.CMB.2.raw
  modified_base (361)..(361): a, c, t, g, unknown or other
  modified_base (369)..(369): a, c, t, g, unknown or other
tcagtctacgtagccacgaccggtgctcgatttagagctcacgtattgggtttgggggagtcagactcagtcaggacacagaatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatgtgctggttcagcaagaacgaggaaacacccaaaagtcctagactctctcgccgcctctacttgacgtaaaggtcgggtacccatacgaagtcagcggcagtgatcgtggacagtatcagtcncacatcancagcctgacacgctagacgttatttcgacttaactactactacgacctaagtacgactaaagttaactaaacgtcgtaacgggtttaccggggaacggggtaacgggtaaacccggtaaggggttacggaaaacgttaacgttaaaccggaaaaacggttaccggttaggttacggccgttacgacccaacgttacgttccgttacgttacctttaccgttacttaccccggtttacccg

SEQ ID NO: 401126 - DNA, 673 bp, Homo sapiens
  misc_feature: GZ8MTXP02IG0TK.15.28.C06.1.454.CMB.2.raw
  modified_base (198)..(198): a, c, t, g, unknown or other
  modified_base (254)..(254): a, c, t, g, unknown or other
  modified_base (265)..(265): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccacctgtctgcatctgtcgganacagagtcaccatcacttgccgggcagtcagtagtattacaatggtgctgttcagnagaacaggaanacccaaagtctagatctctcgccgcctctactttgactaaaggtcggggtaccagtacgtaaggttcagccggacagtgacttcgtaggggaacaggtaattcgacgttaccgtaccacataccaagcgaacgcctgacgacgtccgtagtacgttaacgttttcgaaccttaaacgttaccttaacgtcgtaaccgtaaagtcgtactaaattaaacttaaactacgttaacggttttaccggggacgggaaacggggtaacccgtaaaaggggttagggaaaacggttaaacgtaaaccgtaaaaaccgggttaaaccgttacgggtaacgggtaccttaacgggaaccctaacccgttaacggtttcctacggtttaccctttacggtaaaccttttacccccgg

SEQ ID NO: 401127 - DNA, 619 bp, Homo sapiens
  misc_feature: GZ8MTXP02IMDHL.15.28.C06.1.454.CMB.2.raw
  modified_base (362)..(362): a, c, t, g, unknown or other
  modified_base (527)..(527): a, c, t, g, unknown or other
  modified_base (606)..(606): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgagactctcctgtgaagcctctggtattcaccttgacgcacttatggatgacttgggtccgccaggcctccgaggggagggctgggagtggggtcgccacataacaaaagataggaaagtnaacccgactaaacctagtagtagaaccttctggtgtaagtcgggggtaccctaagtttcccgaacccgttcctaccgaaggaacgacgaaccgaccaaagaacctcaactacagtctgaacaaatacgaaactaaccgagaacggacgcgaaggtacgaccggtntagtgtagttaacgtgtgtagagagtagttcgttcgtcggtcgggttcgggaccgaaccgggtaacccgtcggtacccnccgttcctacccg

SEQ ID NO: 401128 - DNA, 710 bp, Homo sapiens
  misc_feature: GZ8MTXP02IJEAQ.15.28.C06.1.454.CMB.2.raw
  modified_base (369)..(369): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagagtcaccatcacgttcggccggcagtcagtagttattaactaaagtggttggccttggttacagacaagaaaccgaaggaaacgaccccaaaagtcctagactctcgtcgcctcctctactttacgacgtaaaggtcgggtaccagtacgaagtcgagcccgganaggtggatcgtaggaacagtaattcgacgtcctaccaacctataccgacgacgaacggtccctacggccacgtaccgtaggtaacgttaacgtttacgaaccttaaaccgtttaacgtaccgtacgtaacccgtaagtacgtaactaaattaaacttaacgttacgtaacggggtttaccgggaacggggtaacggggtaaaaccgtaaagggggttacggaaaacggttaaacgtaaaaccgtaaaaaccgggtaaacggtttacggtacgggtaacgtacgtaaacccgtaacctaacgtttaccgtacgtttacccttaccgttaccgtttacccccg

SEQ ID NO: 401129 - DNA, 544 bp, Homo sapiens
  misc_feature: GZ8MTXP02JPEIY.15.28.C06.1.454.CMB.2.raw
  modified_base (360)..(360): a, c, t, g, unknown or other
  modified_base (369)..(369): a, c, t, g, unknown or other
  modified_base (530)..(530): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggttcagcagaaccagggaacgccccaaaagtcctagactctctcgccgcctctactttcgacaaagtcggggtccatcaaggttcagccggcagtgatcgtaggggacngtaaacttnacgtctcgaccatacagcagcctgacagcctagaccgtattttgactaacttactactgacctaaagtcgacaataaatactactagtttcggacggtaacgggaccgaagggtaggaagagtacaaaacgtaccgtagtcggactgaaccactactcgtntacttcactttccc

SEQ ID NO: 401130 - DNA, 528 bp, Homo sapiens
  misc_feature: GZ8MTXP02JFCQQ.15.28.C06.1.454.CMB.2.raw
  modified_base (198)..(198): a, c, t, g, unknown or other
  modified_base (275)..(275): a, c, t, g, unknown or other
  modified_base (358)..(358): a, c, t, g, unknown or other
  modified_base (474)..(474): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtatactaaatggttggcctggttcagcagaaaccagggaaacnccccaaaagtcctgatctctgccgctctactttgacaaagtcggggtccagtcaaggttcagccggcagtggatcgtgggacngaattcagtctcacatcagcacgcctgcagtcctgacgtatttcgactaacttactactgacctagtgacaataataatcgtagtttcggacggagggtaaccgaagggtacgganagtacgaaaacgtaactgtacggctagccactatctgtcctttcactttccccg

SEQ ID NO: 401131 - DNA, 605 bp, Homo sapiens
  misc_feature: GZ8MTXP02JL4DY.15.28.C06.1.454.CMB.2.raw
  modified_base (252)..(252): a, c, t, g, unknown or other
  modified_base (254)..(254): a, c, t, g, unknown or other
  modified_base (396)..(396): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccgggcagtcagagtattactaatggtgctgttngnagaacaggaacacccaaagtctgatctctgcccgctctactttgacgtaaaggtcgggtccagtacgtaaggtcaggccggcaggtggatcgtagggacagaattcagtctacacatcagcacgctgcagctcgtaacgttntttacgacttaactttactacgtcgtaacgtaagtctactaaattaaactaactacgttaacgtttcggggaaccgggtaaggggtaacccgaaagggggttacgaacggtaactaaaccggtaaaaccgtaaggttacggtacgggttacaccggaacctaacccgtacggttaccttacggtttaccttaccgttaactttcccccg

SEQ ID NO: 401132 - DNA, 674 bp, Homo sapiens
  misc_feature: GZ8MTXP02IRM27.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttggccggcagtcagtagtattaactaagttggttggtccttggttcagacaacgaaaccgaaggaaacgaccccaaaagtcctagatctcgtcgcccgtccttcgttacgtttgaacgtaaacgggtcggggtacccatacgtaacggttcgacggcccggacgaggtggtagtcgtagggacagtaattacgagtcctaccaacactacacgcgacgcctgaccgacgtccgtaggtaacgttagttttacgaccttaaacctttaccgtaacgtacgtaacccgtaagtacgaaccttaaattaaacgttaactaacgttacggttttacggggaccgggtaaacgggtaaacccggaaagggttaggaaaacgtacgtaaacgtaaaacggtaaccgttggtacgacgtacgaacctacgtaacttctacgtttaccttacgttacctttaccccg

SEQ ID NO: 401133 - DNA, 555 bp, Homo sapiens
  misc_feature: GZ8MTXP02IF0ZA.15.28.C06.1.454.CMB.2.raw
  modified_base (199)..(199): a, c, t, g, unknown or other
  modified_base (335)..(335): a, c, t, g, unknown or other
  modified_base (379)..(379): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctggtcgganacagagtcaccatcacttgccggccagtcagagtatactaatggtgctgttcagcagaacaggaacacccaaagtcagatctctcgccgcctctactttgactaaggtcgggtaccatacgtaggtcagtcccggngagtggattcgagggacagtaacttcacgttcctcactatcagnacgctggcagctagacttagtttcgactaacttactactagacctaagtcactaagtaaatactacgtagttcgggacgggacggaacgaggtacggaagtactaacgtaaaacggacgttcgggacggtactacggtaaccacgtacgttcgtacgttccttactacgttccccg

SEQ ID NO: 401134 - DNA, 585 bp, Homo sapiens
  misc_feature: GZ8MTXP02HSL3T.15.28.C06.1.454.CMB.2.raw
  modified_base (305)..(305): a, c, t, g, unknown or other
  modified_base (334)..(334): a, c, t, g, unknown or other
  modified_base (377)..(377): a, c, t, g, unknown or other
  modified_base (459)..(459): a, c, t, g, unknown or other
  modified_base (485)..(485): a, c, t, g, unknown or other
  modified_base (524)..(524): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccgaggccggggggtcctgagactctcctgtgagcctctggattcaccttgagcacttatggatgacttgggtccncaggctccgaggggagggctggagtgggngccacataaacaaaaagtaggaagtgaacacaaacctatgtanactctagtgagtcggggcctaattcccgaccgtctccctcacgccctacccacgaacgggcccagtccggtccttcccccgnggcccgccctacgcctccgaagggcnccacccgcgacgacgacacgacgccgcccgtggggcccncgccgtacggtacgaacgtaccttaccgtccgtacgtacgtacgacgtcggacggtcggcg

SEQ ID NO: 401135 - DNA, 589 bp, Homo sapiens
  misc_feature: GZ8MTXP02HT49Q.15.28.C06.1.454.CMB.2.raw
  modified_base (277)..(277): a, c, t, g, unknown or other
  modified_base (289)..(289): a, c, t, g, unknown or other
  modified_base (331)..(331): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggcagtcagagtatacaatggtgctgttcagcagaacaggaacacccaaaagtccngatctctcgccnctcttattgacaaaggtcgggtaccatacaaggtcaggccgnagtgatcgtgggacaggtaattcaagtcctacaaccatcaagcacgctgcagcctgacgtatttcgacaaacttactactgacctaaagtcgaactaataaataaactcgtaaagtttccgggacgggtaacgggtaaccgaaaggggtacgggaaagtaacgtaaacgaaaaacggtaaccgttagggttaacggccttagggaaccgtaaaccgtacgtttaaccctggtttaccgttaccttaacgtttaccccg

SEQ ID NO: 401136 - DNA, 541 bp, Homo sapiens
  misc_feature: GZ8MTXP02GGVXA.15.28.C06.1.454.CMB.2.raw
  modified_base (354)..(354): a, c, t, g, unknown or other
  modified_base (400)..(400): a, c, t, g, unknown or other
  modified_base (534)..(534): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaatggtgcctggttcagcagaaccaggaaacacccaaaagtcctagatctactcgaccgcctctactttgacaaagtcgggtccatcgaaggttcagccgcagtgatctgggacngtaatcagtctcaccatcagcagcctggcagtcctggactagtttnactaacttactactcgacctaagtcgactataaactaaacgtctaggtttacgggacgggtaagggtaccgtaagggtaggagtaactaacgaaaacgtacgtgtacggctagctacctatcgtattctacgtnttccccg

SEQ ID NO: 401137 - DNA, 679 bp, Homo sapiens
  misc_feature: GZ8MTXP02IZADP.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttggccggcagtcagagtatactaagtggtgctgttcagcaagaacgaggaacacccaaagtcctagatctctcgcccgtccttacttactttcggactaaaacgggttcgggtaccccaagttaccgaaagggtttccgaacggcccggacgtaggtcgggtaacttcggtagggaaactaggtaacttaccgacgtacctaccaaccgataccgacgacacgcccgtgacgacgtccgtacgtaacgttgttttacgacttaacttacctaacgtcggaacctaagtacgtactaaaagttaaacttaacgtacgttaacggtttacggggaaccgggttaaacgggaaaccgtaaggggttaaggaaacgtaacgtaaaaccgtaaaaccggtacgttacgggttacgccgtaacgtcctaaacgtctttacgtaccgtttaccttacgtaccttttcccccg

SEQ ID NO: 401138 - DNA, 592 bp, Homo sapiens
  misc_feature: GZ8MTXP02I3JKD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtcctgcatctgtcggagacagagtcaccatcacttgccgggcagtcagagtattactaaagtggttggcctggttcagcagaaaccaggaaacgaccccaaaagtcctgacttctctcgcccgcctacttacgtttgactaaaagggtcggggtcccattacgtaaggttcacggccggcaggtggacgtcgtaggggacagtacttcgagtcctacacatcagcagcctgcacgactagtacgttatttcgactaacttactactcgaccgatgactaaataactaatacgtacgttacgggacggtacggaacgtaagggtaggaagtaacgtaaccgaaaacggtacgtaggtacggtcgtacgaaccgtactaacttacgtcttacctttaccgtactttccccg

SEQ ID NO: 401139 - DNA, 540 bp, Homo sapiens
  misc_feature: GZ8MTXP02GENYU.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctgttcagcagaacaggaaacaccccaaaagtcctagatctctgcccgcctctactttgacaaaggtcggggtacccatacaaggttcagccggacagtggatcgtaggggacagaattcgagtcctacacatcagcagcctgcagcctgactatttgactaacttactactgacctaagtcactaataaataatactagtttcgggacggtaacggacgaagggtaggaagaattaccgaaaagacgttgacggtctacggcaccgattcgtagtaccttcactttccccg

SEQ ID NO: 401140 - DNA, 620 bp, Homo sapiens
  misc_feature: GZ8MTXP02HGNJM.15.28.C06.1.454.CMB.2.raw
  modified_base (200)..(200): a, c, t, g, unknown or other
  modified_base (292)..(292): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctcccgtccaccctgtctgcatctgtcgganacagatcacatcacttggccggccagtcagtatattactaagtggtgactgttcagacaagaacgaggaaacacccaaagtccagatctacncgcctctctacttgacgtaacgtcgggtccactacgtaaggtcacggccgacgagtggactcgtaggacagtacttacggacttactaccaactacgtcgacgtacgacgcgcgactagtccgtagtaacgttagtttacgacctaaacttaacgtacgtacgacctaaggtactaactaataaacttacgtacgttacggttacgggaccgggtaacggaacggtaacgggtaggaaaacgtaacgtaaaccgaaaacgtacggttaggaccgtacgtacgaacctacgttacttacgttcgtttacccttacgttaactttccccg

SEQ ID NO: 401141 - DNA, 607 bp, Homo sapiens
  misc_feature: GZ8MTXP02I2GC4.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttggccggccagtcagtagttattaactaaagtggttggtccttggttacagacaagaaaccgaaggaaacgaccccaaaagtccctagactctctcgcccgtcctacttacgtttgacgtaaacggtcgggtaccatacgtaaggttcagccggacagtggatcgaggacagtattcacgtcctacacatacagcacgcctgacacgtcctcgtaacgttatttacgacttaacttaactactacgacctaagtcataataaacttactacgttaggttaccgggaggaacgggtacgtaaaggtacggaagtaactaaacgaaaacggtacgttacggtacggtctacggaacctaaccgtacttccgtacgttccttactactttccccg

SEQ ID NO: 401142 - DNA, 745 bp, Homo sapiens
  misc_feature: GZ8MTXP02IY5F4.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaatggtgcttgttcagcaagaacgaggaacaccccaaagtcctgatctctcgccgtcctacttactttcgacgtaaaacgggttcggggtaccctaagttaccgtaaaggttccgaacggtcccggacgtagggtcggtacgttacggtacggggaactaggtaactttaccgtaacgttccctaccgaaccgtattaccgaaacgccgaacggtccctaggacccgtaacgtacccgttacggaaccgtttacgttttaccgaaccttaaaccgttttaaccttaaacccgtacgggtaacccctaaaggttaccgtaacctaaaattaaaacttaaacgttaccgttaacgggtttaaccgggggaccgggtaaaacgggggtaaaccgttaaaagggggttacggaaacgtaaacgttaaacccggaaaacgtaacggttggtacgggtactacgggaaccctaccgtaacgtttccgtagtttacctaaccgtacctttcccccg

SEQ ID NO: 401143 - DNA, 518 bp, Homo sapiens
  misc_feature: GZ8MTXP02FR028.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaagaccccaaaagtcctagatactctgccgcctctactttgcaaaagtggggtcccatcaagttcagccgcagtgatctgggacngattcagtctcaccatcagcagcctgcagcctgacgtattttgactaacttactactgaccaagtcacaataaatatacgagtttcggacggagggacaagggtaggaggatacgaaaacgaacgtgtacggctacgaacaccatctgtcttactactttcccg

SEQ ID NO: 401144 - DNA, 701 bp, Homo sapiens
  misc_feature: GZ8MTXP02FET47.15.28.C06.1.454.CMB.2.raw
  modified_base (356)..(356): a, c, t, g, unknown or other
  modified_base (391)..(391): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccaggccgggggggtcctgagactctcctgtgaagcctctggattcaccttgagcacttatggatgacttgggtccgccaggctccgaggggaaggggctgggagtggggtcggaccaccataacgaaaaaagntaggaagtgaccactaaccatgtagaacctcgtgnggaattgggggaccctatttccgaacccgttctacccgaagacggacgaaccgaccaaaagacctacaacctaaccagtaccgttaggactaaaacgtaggaaaacctaacccgtaggaacggaacggtacccggaagggtaacccgaacggggccttacggtacggtttaattaaacccggttggtacggtttaggtaacggaaaggtaagtttacggttaccgtacgggtaccggggttcgggggacccgtaaacgggggaaacccccgttggggtttacccaaacccgggtttcctttaacccccgg

SEQ ID NO: 401145 - DNA, 807 bp, Homo sapiens
  misc_feature: GZ8MTXP02FXM71.15.28.C06.1.454.CMB.2.raw
  modified_base (201)..(201): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatcgtggtcgganacagacgtccaccatccacgttcggcccgggcctagtcaagtagttaattaacgtaaagtgggttacgtccgttggttacagacaaacggaaaccgaagggaaaccaaccccgtaaaagtcctagactctcgtacgcccgtccttacttacgtttcgaacgtaaagggttccgggtaccctaagtaccgtaaggttcgacggcccggtacgtaggtggtaacgtcggtacggggaaacctagtaaacgtttcgaaacgttccctaccgtaaaccgtactaccgaacgaccgtaacccggtcccgtacgaccgtaaccggtacccgtacgttaaaccggttttactttacgaaacccttaaaccgttttaaacccttaaccggtaccggtaaacccttaagggttacgtaaaaccttaaagttaaaacttaaacgttcggttaaacggggtttaccgggggaacgggtaaaacggggtaaccgtaagggggttaaggaaaccgtaaagtaaaccggtaaaaaccggtggttacgggtacgtaccgttaacgaaccttaaacgtacggtttctaccggtttaccttaccccgtaccctttacccccgg

SEQ ID NO: 401146 - DNA, 528 bp, Homo sapiens
  misc_feature: GZ8MTXP02JOVGE.15.28.C06.1.454.CMB.2.raw
  modified_base (267)..(267): a, c, t, g, unknown or other
  modified_base (502)..(502): a, c, t, g, unknown or other
  modified_base (512)..(512): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaatggtgctgttcagcagaacaggaaanccccaaaagtcctagatctctgccgcctctactttgctaaaagtcggggtaccagtcaaggttcagccggcagtggatcgtgggacaggaacttcagtctcaccatcagcacgcctagcagccctagacgtattttcgactaacttactacttggacccaagtcgactaataataactctagttcggcgggaagggaccgaagggtcggaagtactacgaaacgagtcgtacgcngcaccattcngtactcgtacttcccg

SEQ ID NO: 401147 - DNA, 602 bp, Homo sapiens
  misc_feature: GZ8MTXP02FHJ1D.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcactgccggcagtcagagtatactaatggttgctgttcagcagaacgaggaaacgaccccaaaagtcctagatctcgtcgcccgcttctactttcgacgtaaaggtcgggtaccctatcgaaggttcaggccgcgagtggatcgtagggaacagaacttcagtctacaacatacgagcacgccctgaccacgtccctagtaaccgttagttttcgaactaacctttacctacgtacgaccctaaaggtcaactaaattaaacttaactacgttaggtttaccggggacgggtaacggggtaaaccgaaggggttacggaagtaacgtaaacgaaaacggtactaggtacggctacgaaccaccgtattctacgttcctactacctttccccg

SEQ ID NO: 401148 - DNA, 904 bp, Homo sapiens
  misc_feature: GZ8MTXP02H7TEH.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccacctgtctgcatctgtcgganacagagtcaccatcacttcggccgggaccagtcagtagttattaactaaagttggttcggccttggttcagacaacgaaaccgaggaaacgaccccaaaagtcctagatactcgtcgcccgtcctacgttactttacgacgtaaagggttcggggtaccccaagtaccgtaaacgggtttccgaacggtccccgggacgtagggtacgggtaacgttacggttacggggaaaccgtacgttaaacgtttccgaaacggtttacccttacccggtaaacccgaacttacccgaaacccgggtacaacccggtaccccgttacgggtacccgaaacgggttacccccgttaaggttaaaccccggtttaagtttttacccggaaaccgtttaaaaccttttaaaccccgttaccggtttaaccgggtaaaccccgtttaaaagggtttacggaaacccttaaaaggtttaaaaccgttaaaaacgtttacccggtttaaaccggggtttttaacccgggggtaaaccgggggaaaaccgggggttaaaacccgggtaaaacgggggtttaaggggaaaacggtttaaccgaaaaccggttaaaaaacccgggttacggttacgggtaacgggttcccgttaaaccgggaacctaaacccgtaacgtttcggttaacctttccggtttaacctaaccggtttaccccccg

SEQ ID NO: 401149 - DNA, 706 bp, Homo sapiens
  misc_feature: GZ8MTXP02IWFV2.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtcctgcatctgtcggagacagagtcaccatcacttgcccgggccagtcagtagtaattaactaagtggttggccttggtttcgagacaagaaaccgagggaaacgacccccgaaaagtcccgtagactctctcgccgtccctcttacgtttgacgtaaacgggtcggggtccctacgtacgtaacggtcgacggcccggacgaggtaggacgttcgtacggggaactaggttaacttaccgtacggttaccctaccacctatcccgaagcaaccgccttcgacccgaggtcccgtcgtaacgttacgtttttacgaacccttaaccgtttaacttacccgtgaaccccgttaaggtacgaaccttaaattaaaccttaattaccgtacgggtttaaccggggacgggtaacggggaaccgtaagggtaaggaacggtaactaaacggtaaaacgtacgtagggtacgtcccgttacggaaccgtaacccgtagttccttcggttcccttactaccttttcccccg

SEQ ID NO: 401150 - DNA, 551 bp, Homo sapiens
  misc_feature: GZ8MTXP02HDQU9.15.28.C06.1.454.CMB.2.raw
  modified_base (504)..(504): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgcaggctccgaggggaaggggctggagtgggtggccaccataacaaaagataggaagtgaccacaacctatgtgaactctgtgagtcggggcctattcgaccgtctccgagacgacgacgccaaagactcaactacatcctgacaaatcgaacaactgagagcccgaggacacggctgtagtatacgtgtgtgagagactgttcnggtcggtggggacccacggggtaccctgggtaccacccgtcgtcccg

SEQ ID NO: 401151 - DNA, 610 bp, Homo sapiens
  misc_feature: GZ8MTXP02JJLN1.15.28.C06.1.454.CMB.2.raw
  modified_base (197)..(197): a, c, t, g, unknown or other
  modified_base (340)..(340): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtatactaagtggttgctgttcagcaagaacgaggaaacgaccccaaagtcctgactctcgtcgccgtctctactttgactaaggtcgggtaccagtcgtaggtcagcccgnaggtgtactcgtagggacagtaacttcgagtcctcgactatcagcacgcctgacacgtcctacggtacgttacgttttacgaccttaaccttaccgtactacgtaccctaagtcaacttaaataacttaacgtacgttaacggtttccgggacggggtaacgggtaaccgtaaaggggtacgtaaacgtaaacgtaaaccgaaaacggtacgtcggtaccggtacgtacggaaccgtaacctagttctcgttcttacctacgtttccccg

SEQ ID NO: 401152 - DNA, 563 bp, Homo sapiens
  misc_feature: GZ8MTXP02GITLA.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggcagtcagagtatactaatggtgcccctgttcagcagaacgaggaacgacccaaagtcctagatctctcgccgcctctactttgacgtaaaggtcggggtaccagtacgaaggttcgaggccggcgagtggatcgtaggacagtaatcagtctacacatcagcacgcctcgcacgtctacgtacgtatttcgactaacttactactacgactaagtcactaataactaatactacgtttacggacgggaacgggaacgaagggtaggaacgtaacgtaacgtaaaacgtacgtaggtacggacgtacgaaccactacgtctcgtacttactactttccccg

SEQ ID NO: 401153 - DNA, 621 bp, Homo sapiens
  misc_feature: GZ8MTXP02FSHWM.15.28.C06.1.454.CMB.2.raw
  modified_base (286)..(286): a, c, t, g, unknown or other
  modified_base (411)..(411): a, c, t, g, unknown or other
  modified_base (479)..(479): a, c, t, g, unknown or other
  modified_base (492)..(492): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttcgccggcagtcagatatataagtggtgctgttcagacaagaacgaggaaacacccaaagtcctgactcnctcgcccgtctctactttcgacgtaaaaggtccgggtaccctataccgaaggttacgaggccccggacgtaggtacggacttaccggagggaacctaggtaactcgtacgttcctaccaacctanaccacgacgaaccgccgtggacctacgtcccgagttaccgttatttacgaaccttaactttactaccngtaaccctagtanaacctaaaattacttaaacgtcgttacggtttacggggacgggaacgggaacggtaagggtgaaacgtactaaacggaaaacgtcggtaagtcggctacgaacgtactactcgtcttcactctttcccg

SEQ ID NO: 401154 - DNA, 630 bp, Homo sapiens
  misc_feature: GZ8MTXP02HQZQU.15.28.C06.1.454.CMB.2.raw
  modified_base (198)..(198): a, c, t, g, unknown or other
  modified_base (275)..(275): a, c, t, g, unknown or other
  modified_base (604)..(604): a, c, t, g, unknown or other
  modified_base (614)..(614): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccacctgtctgcatctgtcgganacagatcaccatcacttgccggcagtcagatatactaatggtgctgtcagcagaacaggaacaccaaagtctgatcnctgcctctactagttcgacgtaagggtcgggtaccatacgtaacggttcacggccgggactaggtggaacttcggtacggggaactacgggtaaactttccgaagtttaccccttacaaaccctaagtcccgaaagacccgtaacgggtcccacgggtaccaacggtcccgttacgtaacgtttacttttacgacccttaaacgtttactaccttaccggaactaaggttacactaaataacgtattaccgtaggtttccgggaacgggacgggtaacgaaaggtggtaaaaggtactaacgtaaaacgtcgtagtcggctacgaaccncgtacgtctntaccttcagtttcccc

SEQ ID NO: 401155 - DNA, 784 bp, Homo sapiens
  misc_feature: GZ8MTXP02G2Z5M.15.28.C06.1.454.CMB.2.raw
  modified_base (304)..(304): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtcctccgtccacctgtctgcatccgtgtcggagacagacgtccacatccacttcggccgggaccagtcaagtagttattaactaagtggttagccttggttcagacaagaaaccgaggaaaccgacccaaaagtccngaactccgtctcgtcccgtccttaccttacgtttacgacgtaaaacgggttcggggtaccctaagtacgtaaacggttcgacggccccggtacgtaggtacggtacgttcgggtaacggggtaacgtacggttaaacctttaccgtaacggttacccgttaacccaaacccggtaacttacgaaaccgccgtacccggtacccgttcgaaccggttacgtaccccggttacgggtaacgtttaaacggttttacgaaccctttaaaaccgtttaaaccgttacccgttaaccggtaacccgttaaaggtaacgtaacccgtttaaaattaaaacgtttaccttacggtaacgggtttaccgggaacgggtaacgggtaaaccggaagggttaccggaagtaacgtaaacgtaaaacgtacggttacggacgtcgtacgaaccgtaccgtattccgtagtaccttcctacggtttaccccc

SEQ ID NO: 401156 - DNA, 675 bp, Homo sapiens
  misc_feature: GZ8MTXP02HRS7L.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccggcagtcagagtattactaagtggtgcctggttcagcagaacgaggaaacacccgaaaagtcctagatctacgtcgccgcctctactttgacgtaaaggtcggggtaccagtacgtaaaggttcaacggccggactaaggtggtaacgtcggtaggggacaggtaattacgacgttcctaccgaaccatacaacgcaacgtccctagccacgacccgtagtaacggttattttaccgaccgttaaactttaaccgttacgtacgtaccgtaaagtcggtaccaaattaaataaagttacgtacggttttaaccggggacgggttaaacgggaaacccgtaaaggggttaggaaacggttaacaaacgtaaaaacggtaaaccgttgggaacggttcgttacggaaacccgtaaccgtaattcccgtaaggtttcccttaacgttaaccgtttcccccg

SEQ ID NO: 401157 - DNA, 797 bp, Homo sapiens
  misc_feature: GZ8MTXP02GHJYK.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtatactaatggtgctgttcagcagaaccgaggaaacgaccccaaaagtcctgatctctcgcccgtccttctacgtttgacgtaaacgggtcggggtacccaagtcgtaaacggttcaacggccgggaccgtaaggtaggtacttcggtacggggaactaagggtaactttacgaacggttacctaccctaaacccaattaccgaaacgacccgaacggtccctaggacccgaacggttaccccgtacggttaaaccgtttaagtttttaccggaaaccttaaaacccgtttaaacccgttaaaccttacgtaacccccgttaaaagggttaccgtaaaccttaaaattaaaacctttaaagttaccgtttaaaacggttttaccgggggaccgggggtaaaacgggggtaaaccccgggttaaaaggggttaagggaaaacggtaaaccgttaaaacccggtaaaaaccggttaaaaccggttggggttaacggacccgttaaacggaaccccgtaaacctacggtttaccttcggtttacgtttaacccgtaaccttttccccccgg

SEQ ID NO: 401158 - DNA, 665 bp, Homo sapiens
  misc_feature: GZ8MTXP02I2GV2.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttggcttggttcagcaagaaccgagggaaacgaccccaaaagtcctagatctctcgcccgtcctcttactttgacgtaaacggttcggggtaccctagtacgtaacggttcacggccggaccaggtggacttcgtacggggacaggtacttacgacgttcctaccgaccataccgagaccgacgccctgacctagtcccgtgtacgttacgttttcgacctaactttacctacgtacggaccctaagtacgtactaaactaaacttaacgttacgtagggtttaccgggaccggggaaacggggtaaccgtaaaaggggttacggaaacgtaacgtaaaccgaaaacgtaacggttcgggtacggccttacggaaccctaaccgtacgttaccgtgtttaccctttacgtaccttttcccccg

SEQ ID NO: 401159 - DNA, 725 bp, Homo sapiens
  misc_feature: GZ8MTXP02G9J8K.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttggccggcagtcagtagtaattactaaagtggttggccttggttcagacaacgaaaccgaaggaaacgaccccaaaagtcctagatctctacgccgtcctctactttagactaaagggtcgggtaccctaatacgtaacggttcaggtcccggacgtaggttaggtagtcggtacggggaacaggtaaacttcgtacgtctacccaacattacccgagaccgaacgtccctcggccgtaaccgtacccgttacggtaaacgttacgtttttacggaaacccttaaaccttttaaccgtaaaccgttccgtaaacccgttaacggtacgtaaacgtaaaacgttaaaactttaaccgtaacgtttaacggtttacccgggggacggggtaaaaccgggtaacccgtaaaggggtaggaaacggttaaactaaaccgtaaaacgtaacggtcgtacgtacgttaccgaaccgtaaccaaggttccttacgttccttacctaactttcccccg

SEQ ID NO: 401160 - DNA, 654 bp, Homo sapiens
  misc_feature: GZ8MTXP02JWRII.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggtgctgttcagcagaacaggaacacccaaagtcctagatctctcgccgctactactttcgacgtaaaggtcggggtaccagtacgtaaggttcaggcccggacaggtcggatcgtagggactagtaacttcgaacgttcctacacatcagcacgcgtcgctacgccgtagtacgttatttacgactaaccgttactacgtacgtacctaagtacgtactaaattaaactttaacgtacgttaacggtttaccggggaacggggtaaaccggggtaaaccggtaaaggggttaccgggaaaagtaaacggtaaaccgtaaaaacccggttacgttacgggtacgggtccctacggtaacccgtacccttaagttacccgtttcggttaaccctttcctaaccggttttcccccg

SEQ ID NO: 401161 - DNA, 587 bp, Homo sapiens
  misc_feature: GZ8MTXP02GFB30.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaaccagggaaacgaccccaaaagtcctgatctctgccgcctctactttgacaaaagtcggggtcccatcaaggttcaggccggcagtggatcgtgggacagtaatcagtcctcacatcagcacgcctagcagccctgtacgtattttgactaacttactactgacctaagtcactaataaataacttctaacgtttcgggacgggaacggggtaaccgtaagggttacggaagtaacgttaacgaaaacggtaaaccgtggttacggacttacggaaccgtaacctaacttccgttagtttacctttacaacgttttcccccg

SEQ ID NO: 401162 - DNA, 810 bp, Homo sapiens
  misc_feature: GZ8MTXP02HUE93.15.28.C06.1.454.CMB.2.raw
  modified_base (264)..(264): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggtgctggttcagcagaacaggaanccccaaaagtcctgatctctgccgcctctacgtttgacgtaaaggtcggggtacccagtaccgtaaacggttcgaacggtcccggaccgtaagggttcgggaaagttaccgttacgggggaaacctaggggtaaaactttttaccgaaacggtttcccttacccgaaacccccgttaaattccccgaaagggccctaaacggggtccccttagggaccccgaaaggttcccccgtaggggttaaaccgtaacgtttttaccggtaaacccttaaaaccttttacccgttaaaccgttaccggaccccgtttaaaggtacgggttaaccgaaaacgtttaaaattaaacgttaccgtaacggtttttaccgggggaacggggtaaaccggggtaaaacccgggaaagggggtttacggggaaacggtaaacgttaaacccggaaaaacggtttaaaccggtgggttacggggtacctttacgggaacccgttaacccgaaacttttaccgtcggttttaccgtttacccttaacggttttacccccg

SEQ ID NO: 401163 - DNA, 526 bp, Homo sapiens
  misc_feature: GZ8MTXP02GIH31.15.28.C06.1.454.CMB.2.raw
  modified_base (391)..(391): a, c, t, g, unknown or other
  modified_base (427)..(427): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggttggcctggttcagcagaaaccaagggaaagccccaaaagtcctagatctctgccgcctctactttgcaaagtcggggtcccatcaaggttcagccggcagtggatctggggacagaattcagtctcacatcagcagcctgcagccngacgtattttgacctaattactactgacccaaagtnactaaataataatacatttcgggcgggaaggaccgtaagggtacggaggatacaaaacgtaaactgtcggctagcacgactctcgtctacactttcccg

SEQ ID NO: 401164 - DNA, 585 bp, Homo sapiens
  misc_feature: GZ8MTXP02F97UM.15.28.C06.1.454.CMB.2.raw
  modified_base (392)..(392): a, c, t, g, unknown or other
tcagtctacgtagccacgaccggtgctcgatttagagctcacgtattgggtttggggggagtcagactcagtcaggacacagcatggacatgagggtcccgctcagctcctggggctcctgctgctctggctccgaggtgaccaaatgtgacatccagatcgacccagtcctccgtccacctgtctgcatctggtcggagacagagtccaccatcacttggcccggcagtcagagttaattaactaagtggttggccttggtttcagacaagaaaccgaagggaaacaccccgaaaagtccctagactctctcgcccgtcctctactttgacaaacggtcggggtacccagtacgaacggttcaggcccgacaggtggatcggtagggaacngtaacttcagttccacacatcacgacacggcctgacacgaccgtcgtaacgttattttcgaccttaaacgttactaacgtcgacctagttacaactaataaactaatcgtagttcggacggtacggacgagggtacgaggactaacgaaacgtacgtggtacggctagcaactctcgtctactcactttcccg

SEQ ID NO: 401165 - DNA, 674 bp, Homo sapiens
  misc_feature: GZ8MTXP02H0DL1.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcacatcacttgccgggcagtcagatattactaatggttgctggttcagcagaaacaggaaacaccccgaaaagtcctagactctctcgcccgtcctctactttgactaaaggtcgggtcccatcgtaaggttcaggccggcgtacggtggaacgttcgaggggaactaggtaacttcgtacgtccttaccacaactccgaagcacgtccctgaccaacggtacctacggtaacgttagttttacgactaaaacctttaccttactcggtaccctaaagttcgactaaattaaagtaacttacgttacggtttacggggacggggtaaacgggaaccgtaaagggggttaccgggaaaagtaaaccggttaaacgaaaacgggttaaaccgttcggtacgggttacccgtacggaacccgttaccctaagtttccgttaacggtttcctttacgttaaccgtttcccccg

SEQ ID NO: 401166 - DNA, 574 bp, Homo sapiens
  misc_feature: GZ8MTXP02HDPYW.15.28.C06.1.454.CMB.2.raw
  modified_base (198)..(198): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagacgtcaccatcacgttggccggccagtcagagttatactaagtggtgctgttcagcagaacgaggaacacccaaagtccagatctcgtcgccgtcctactacgtttgacgtaaacgggtcgggtaccatacgtaaggtcgagccggacgtaggtcgagtcgtagggaactaggtaactttcgacgttcctaccacataccgagacctacgccctaggacctacgtcgtacgacgtttactttacgacttaacttacgactacgacgtaagtacataataatactcgttaacgtcgggaccggaggaacgagggacgtaagataacgaaagtaacgtggacgtcacgcactctcgtctccttactacgttccc

SEQ ID NO: 401167 - DNA, 601 bp, Homo sapiens
  misc_feature: GZ8MTXP02I1KSU.15.28.C06.1.454.CMB.2.raw
  modified_base (358)..(358): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccggggggtcctggagactctcctgtgaagcctctggattcaccttgagctacttatggatgacttgggtccgcaggctccgaggggaagggctggaggtgggtcgccacataaacaaaagntaggaagtgacacaacctatgtgactctagtgagtgggcctattccaccgtctccctcacgccctacccaccgaacgggccctagtcccgggtcccttcccccgtggccccgtccctacgccctcccgaagggtccgccctacccgtccggaacgacgcccaacgacggcccggtcccgtggggcctcgaccgtggtaccaacggtcctacgtccgacgtacgtacgacgtggacgcgggtcg

SEQ ID NO: 401168 - DNA, 640 bp, Homo sapiens
  misc_feature: GZ8MTXP02IRD53.15.28.C06.1.454.CMB.2.raw
  modified_base (257)..(257): a, c, t, g, unknown or other
  modified_base (350)..(350): a, c, t, g, unknown or other
tcagtctacgtagccacgaccggtgctcgatttagagctcacgtattgggtttggggggaagaggaagactgaaggcctttccacttggtgatcagcactgagcacagaggactcaccatggaattggggctgagcttgggttttccttgttgcttattttagaaggtgtccagtgtgaggtgcaactggtggagtcgtgggggaggcctcgtccgaggcccggggggtccctggacgactctcctgtagaagcctntggattcaccttgagctacttattggattgacgttgggtccgccaggctccgaggggagggctggaggtgggtgcccacataaacgaaaaagngtaggaagtgaacaactaaacctatgtagaacctctgtagagtcgggacctattccgaccgtctccgagacgacgacgacaaagactacactacatctagacaaaatacgaaaccaccgtagaacgtacggaaccggaacggacgacggtcttaggtagttaacttacgtggtgtagagtagtagttcgttacggtcggtcgggttacggggaccgtaacggggtacccgttggacccgttaaccgtcccgtacctaccgaccgtccctaaccccgaaccgtaacccggg

SEQ ID NO: 401169 - DNA, 546 bp, Homo sapiens
  misc_feature: GZ8MTXP02IX5IK.15.28.C06.1.454.CMB.2.raw
  modified_base (268)..(268): a, c, t, g, unknown or other
  modified_base (435)..(435): a, c, t, g, unknown or other
tcagtctacgtagccacgaccggtgctcgatttagagctcacgtattgggtttgggggagtcagactcagtcaggacacagcatggacatgagggtccccgctcagctcctggggttcctgctgctctggctcccaggtgccaaatgtgacatccagatgacccagtctccgtccaccctgtctgcatctgtcggagacagagtcaccatcacttgccggcagtcagagtatactaaatggtgctggttcagcagaaaccaggaaacnccccaaaagtcctagatctctcgccgcctctactttagactaaaggtcgggtcccatacaaaggttcaggcggtaccgagtgatcgtagggacagagttcagtctcacatcagcagcctgcagccctagacgtatttcgactaacttactactacgtaccaaaggtnataataaatacgtcgtaggtacggacggacggtacgaaggagaacgtacgtaacgaaacggtacgtaggcgtactcgactaacgtatcgtctacttacctacttcctaccg

SEQ ID NO: 401170 - DNA, 568 bp, Homo sapiens
  misc_feature: GZ8MTXP02HXA74.15.28.C06.1.454.CMB.2.raw
  modified_base (239)..(239): a, c, t, g, unknown or other
  modified_base (286)..(286): a, c, t, g, unknown or other
  modified_base (338)..(338): a, c, t, g, unknown or other
  modified_base (449)..(449): a, c, t, g, unknown or other
  modified_base (478)..(478): a, c, t, g, unknown or other
  modified_base (495)..(495): a, c, t, g, unknown or other
tcagtctacgtagccacgaccggtgctcgatttagagctcacgtattgggtttgggggaagaggaagactgaaggcctttccacttggtgatcagcactgagcacagaggactcaccatggaattggggctgagctgggttttcctgttgctattttagaaggtgtccagtgtgaggtgcaactggtggagtctgggggaggcctcgtccaggccgggggggtccctggagactctccngtgaagcctctggattcaccttgagcacttatggatgacttgggccnccaggcctccgaggggagggctgggagtgggtggccaccgataacaaaaagntaggaagtgacacaacctatgtagaacctcgtgtgatggggaccattccaccgtctccgagagacgacgaccaaagtactcactacatctagaccaaatcgaaacactgangccgaggtacaggctagtgtattacgtgngtgagtgatcgtttcgnggtcggtcgggaccacgggtaccctggtacctaaccgtcctaccgtacaccgtacccctaccgaaccgtacgg

SEQ ID NO: 401171 - DNA, 598 bp, Homo sapiens
  misc_feature: GZ8MTXP02F9Y7Y.15.28.C06.1.454.CMB.2.raw
  modified_base (376)..(376): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagacgtcaccatcacttgccggccagtcagagtattactaagtggttggctggttcagacagaaccaggaaacgaccccaaagtcctgatctctgccgctctactttgacaaaggtcgggtacccatacgaaggtcagccgcagtgatcgtaggacagtattcgagtctcactacncagcagccgtagcgacgcgtagacgttatttcgactaacttacacgtcgacctaaagttcactaaattaaacgtaacttacgtaacggtttcgggaacgggtaacgggaaccgaaaggggtagaaacgaagttaaccgaaaaacggtaccgtagggttcggacctacggaacccgtaaacccgttacgttaccgttaccgtttccttacctaccgtttcccg

SEQ ID NO: 401172 - DNA, 723 bp, Homo sapiens
  misc_feature: GZ8MTXP02G6K22.15.28.C06.1.454.CMB.2.raw
tcagtctacgtagccacgaccggtgctcgatttagagctcacgtattgggtttgggggagtcagactcagtcaggacacagaatggacatgagggtccccgctcagctcctggggctcctgctgctctggctcccaggtgccaaatgtgacatccagatgacccagtctccgtccacctgtctgcatctgtcggagacagatcacatcacgttgccggcagtcagagtattaactaagtggttggccttggttcagcaagaaaccgaggaaacgcccaaaagcctgactctacgccgtccgtcttacttacgtacgaacggtacgggtcccggtactacgtaacggtaacgttacgacggcgtacgtaggtagtacgtacgggtacgaaacgtaagttaccgtagtaccgttccaaccgtaccttacgacgacctacgacctaccgacgacgaccgtacgtacggtttacgtttacgtttactaaaccctttaactaaccgttaacgtacccgtaaagtacggtaacttaaaccttaaagttaaacttacgttaacgttacggggttaccggggtaaacgggtaacccgggtaaacggtaaggggttaacgaaaacggtaaaccgttaaaccgggaaaaccgttagggtacgggttacgaccgtacggaccgtaagttaacttcggttacttaccgttaacttacccgtttcccgtaaccccg

SEQ ID NO: 401173 - DNA, 678 bp, Homo sapiens
  misc_feature: GZ8MTXP02HAZZE.15.28.C06.1.454.CMB.2.raw
  modified_base (304)..(304): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctggtcggagacagacgtcaccatcacttggccggcagtcagagttattaactaagtggttcgtcttggttcagacaaacgaaacgaaggaaccacccaaagtccagatctcncgccctcctcttacttgacgtaacgggtcgggtaccagtacgtaggtcgacggcccggagaggtggacgtcgtaggggactagggtaacttcgaacgttcctaccaacgtatacgacgaccacgccgtacgacctacggtacccgtagtaccggtttacttttacgaacctttaactttacctacgtacgaaccgttaagtaccgtaataaacgttaaacttacgtaccgttaacgggttacggggaacggggtaaccggggtaaacggtaagggtacgggaaagtaaacgtaacggtaaaaccgtaaggttcggtaccgtaaccgtcgaacccgtactacgttcgtaacgtttccctaactccgtttaccccg

SEQ ID NO: 401174 - DNA, 589 bp, Homo sapiens
  misc_feature: GZ8MTXP02JV0ZV.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggcctggtttcagcagaaaccgagggaaacgccccaaaagtcctagatctctgccgcctctactttgactaaagtcggggtacccagtactaaggttcagccggcaggtcgatcgtagggacagaattcagtctcacatcagcacgcctagcagcctgacgttattttacgactaaactttactactagtcccgaaagtgtactaattaaactaaattactaacgttttcgggacgggaacggggtaaccgaagggttcggaaggtaacttacggaaaacggtactagggtacggtcgtaggaacccgtacaacgttcgttcgtacctttctacgtttccccg

SEQ ID NO: 401175 - DNA, 586 bp, Homo sapiens
  misc_feature: GZ8MTXP02JA6RE.15.28.C06.1.454.CMB.2.raw
  modified_base (359)..(359): a, c, t, g, unknown or other
  modified_base (444)..(444): a, c, t, g, unknown or other
  modified_base (500)..(500): a, c, t, g, unknown or other
  modified_base (520)..(520): a, c, t, g, unknown or other
  modified_base (538)..(538): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgagcctctggattcaccttgagcacttatggatgacgttcgggtccgccaggctccgagggggaacgggctgggaggtgggtggaccacccgataacaaaaagntaggaaagtgaccgaccaacctatgtagaactctggtgagtcgggccgtattccaccgtctaccgagacgacgacgaccaagacncactacactctgaactaaatacgaaacaacctgaacggacgtaccgagacgacggntgtagtagttagtcggtagnggagacgttatgttacgnggtcggtcggggaccgacggacccgtggtaccctaccgttcctacccg

SEQ ID NO: 401176 - DNA, 552 bp, Homo sapiens
  misc_feature: GZ8MTXP02IX2OI.15.28.C06.1.454.CMB.2.raw
  modified_base (198)..(198): a, c, t, g, unknown or other
  modified_base (532)..(532): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtattactaatggttgcttggttcagcagaaaccaggaaacgaccccaaaagtcctagatctctcgccgccttcttactttcgacgtaaaggtcggggtacccatactaaggtcaggccggcagtcggatcgtgggactagtaacttcgagttcctcacactcagcagccctgcaagcccgtagactagttttagactaactttactactacgacctaagtcactaataaataactcgtagttacgggacggaggaaacgtaaggtggaatagtaacaaacgtacgtgtacgtcacgcacnttctagttctcactttcccg

SEQ ID NO: 401177 - DNA, 532 bp, Homo sapiens
  misc_feature: GZ8MTXP02JB6WP.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgatctctgccgcctctactttgcaaagtcggggtcccatcaaggttcagccggcagtggatcgtgggacngaattcagtctcacatcagcagcctgcagcctgacgtattttgactaaacttactacttgaccctaagtcactaataataaatctagtttacggacgggtaagggaccaaagggtcggaagataacgaaaacgaactgtacggactggaaccaccatctagtcttcaactttcccg

SEQ ID NO: 401178 - DNA, 636 bp, Homo sapiens
  misc_feature: GZ8MTXP02INJC0.15.28.C06.1.454.CMB.2.raw
  modified_base (198)..(198): a, c, t, g, unknown or other
  modified_base (256)..(256): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagatcaccatcacttgcccgggcagtcagagtattactaatggttgctggttcagnagaacaggaaacgaccccaaaagtcctagatctctcgccgccttcttacttttgactaaaaggtcggggtacccagtacgtaaggttcaggccggacgagtggatcgtaggggacaggtaattacgacgtacctacctaccataccagcgaagcctgcgaacgccgtaggtacgttatttcgacttaaacttaacttacgttcgacctaagtcgtactaaattaaactaactacgttagtttcggggacggtaacgggaccgaaagggttacggaaagaacgttaaaccgaaaaacggtacgttacggtacggtacgttacggaacccgtaaacctaacgtttccgttacggtttacctttacccgtactttaacccccg

SEQ ID NO: 401179 - DNA, 582 bp, Homo sapiens
  misc_feature: GZ8MTXP02I56DH.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggcctggttcagcagaaaccagggaaagaccccaaaagtcctagatctctcgcccgcctctactttgactaaaggtcggggtacccatcaaggttcaggcccggcagtggatcgtggggacagtaattcagtcctcaccatcagcagccctgcagcctgacgtatttgactaacttactactgacctaagtacgactaataaactaattacgtaagtttcggggacgggtaacggggaaccgaaagggttacgggagtaaactaccgaaaacggtaacgtcggtacggcgtacgaacgtacctacgttcctacgttaccttacgtaactttcccccg

SEQ ID NO: 401180 - DNA, 791 bp, Homo sapiens
  misc_feature: GZ8MTXP02ISNIS.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagatccaccatcacgttcgcccgggccagtcagagttattaactaagtggttggccttggttcagacaagaaccgaggaacaccccaaagtcctagatctctcgcccgtccttcttacttagacgtaaacggttcggggtaccctagtacgtaaggtcgacggccggacgtaggtcggtagtcggtacggggaactaggtaacttcgacgttacctaccaacctacgtaccacggacctaaccggtccctacggaccgtaccggtacccgttacgggtaacgttttaacgttttaccgaaacccttaaaccttttaccgtaaaccgttaccggtaaacccgtaaggttacccgttaacttaaaacgttaaaactttaaccgtttaacggttaacgggtttacccgggggaacgggggtaaaaccgggggtaaacccggtaaaagggggttaacggtaaacggtaaaacctaaaccgggtaaaaaaccgggtaaacggtttcggggtaccgggtaccgttaccggaaccctaaccgttacggttttacccttccggttttaaccctttctttaacccccgttttcccccgg

SEQ ID NO: 401181 - DNA, 722 bp, Homo sapiens
  misc_feature: GZ8MTXP02IP6PL.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagagtcaccatcacttggcccggcagtcagtagtattacgtaaagtggttcgccgttggttcagacaagaaaccgaggaaacgaccccaaagtcctagactctctcgcccgtcctacttactttagacgtaaacggtcggggtaccctacgtacgtaaggttacgacggcccggacgaggtcggacgttaccggtacggggaactacggtaacttccgaacggttacctaccctaactactaccgaacgcctacgtccgtacggaccgtaaccgtccgttacggtaacgttacgttttaccgaaccgttaaaccttttaaccgtaccgttaccgtaacccgtaagggtttaccgaacgttaaacgttaaaacttaacgttaccgttaacggtttaaccggggacgggttaacggggaaccgtaaggggttacgggaacgtaacgtaaacgtaaaacggacgttacggtcggtacgttacgaacctaccgtacttcgttacgttcctttactactttccccg

SEQ ID NO: 401182 - DNA, 516 bp, Homo sapiens
  misc_feature: GZ8MTXP02JXUA8.15.28.C06.1.454.CMB.2.raw
  modified_base (355)..(355): a, c, t, g, unknown or other
  modified_base (422)..(422): a, c, t, g, unknown or other
  modified_base (502)..(502): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattaactaaatggttggcctggtttcagcagaaaccagggaaacgaccccaaaagtcctgatctctgccgctctacttgcaaagtcgggtccatcaagtcagccgcagtgatcgtgggacngaatcagtctcaccatcagcacgcctgcagctagacgtatttgactaacttactactcgacctagtnacctaattaataagttccagtttcgggacggtaggaccgtaagggtgacgatacgaaaacgattgacggctagcaacctntctctctactctcc

SEQ ID NO: 401183 - DNA, 634 bp, Homo sapiens
  misc_feature: GZ8MTXP02JL6CU.15.28.C06.1.454.CMB.2.raw
  modified_base (198)..(198): a, c, t, g, unknown or other
  modified_base (595)..(595): a, c, t, g, unknown or other
  modified_base (608)..(608): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagttattactaaagtggttaggcctggtttcagacagaaaaccgagggaaacgaccccaaaagtccctagactactcgtcgacccgccttctacttttagccgtaaaagggttcgggggtcccctaagtccgtaaaggttccacggtacccgggccgaaggtggaacttcggtaggggaacctaggaaacttcaggtctacaccacttacagcaacggcctgcagtccctaggacttagttttcgaccttaacttaactacgtagcctaaagggttcactaattaaacttaagtaccgtagtttcccgggggacggttaacggggaccaaggggtacgatacgtacgaaaccgacgtgtacggcncgaacgaccttanaccgtgttcctacgtacctttacccg

SEQ ID NO: 401184 - DNA, 646 bp, Homo sapiens
  misc_feature: GZ8MTXP02FFKWR.15.28.C06.1.454.CMB.2.raw
  modified_base (202)..(202): a, c, t, g, unknown or other
  modified_base (313)..(313): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgaccaaatgtgacatccagatcgacccagtcctccgtccaccctgtctgcatctgtacgganacagagtccaccatcacgtggccgggccagtcagtagttaattaacgtaagtggttacggccttggttacagacgaacgaaaccgaaggaaccacccaaagtcctgactcnctcgcccgtcttactacttgacgaagggtcgggtaccctagtacgaaggtcacggcccggactaggtgtactcgtagggactagtaacttcgatcctacaacctgacacgacacgccgtacgcacgtccctaggtacttaacgttttcaaccttacttaccgtactacgacctaagtacaactaattaacgtaacttacgtaacggttaccgggacgggtaacggaaccgtaagggtagtaaagtaacgaaaccgtaaacggtaaacgtcggtaaccgggtcctacggaaccctaactacgttccgtaacgtttctaaccttctttacccccg

SEQ ID NO: 401185 - DNA, 577 bp, Homo sapiens
  misc_feature: GZ8MTXP02HI4L4.15.28.C06.1.454.CMB.2.raw
  modified_base (261)..(261): a, c, t, g, unknown or other
  modified_base (338)..(338): a, c, t, g, unknown or other
  modified_base (431)..(431): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtatataatggtgctgttcagcagaacaggaaanaccccaaaagtcctagatctctcgccgcctctactttgactaaaagtcggggtcccatacgaaggttcgagccgganagtggatcgtgggacagtatacagtctctacatcagcacgcctgacacgcctagacgttattacgactaacttactacgtcgacccgtaaagngtactaaactaaattaactacgtacgtttacgggacgggtaacgggaacgaaagggttacggaacgtaacgtaacgaaaacggtaacctggtacgggcttacggaaccgaactacgttactacgtttctaaccttaactttccccg

SEQ ID NO: 401186 - DNA, 597 bp, Homo sapiens
  misc_feature: GZ8MTXP02GUPSY.15.28.C06.1.454.CMB.2.raw
  modified_base (423)..(423): a, c, t, g, unknown or other
  modified_base (441)..(441): a, c, t, g, unknown or other
  modified_base (482)..(482): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccgggccagtcagagtattaactaaagtggttaggcctggttcagacaagaaaccgaaggaaacgaccccaaaaagtcctagaatctactcgacccgccttaccttaactttggactaaaaggtcggggtaccctaaatacgaaaaggttccaaggcccggagaggttagggaactcggttaggggaacagaaacttcaagttcncaaaccatcaagcagccngcacactgtacgtattatactaactactactacacaagtanataaataaataaatactacgtacggacggaacggaacggaaggacggagaagtaaacgtaaaacgaaacgtacgtacgtacgtacgaacgacactactacgtactactactaccg

SEQ ID NO: 401187 - DNA, 527 bp, Homo sapiens
  misc_feature: GZ8MTXP02IDU6X.15.28.C06.1.454.CMB.2.raw
  modified_base (198)..(198): a, c, t, g, unknown or other
  modified_base (254)..(254): a, c, t, g, unknown or other
  modified_base (265)..(265): a, c, t, g, unknown or other
  modified_base (277)..(277): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgtcgggcagtcagagtatactaatggtgctggttcagnagaacaggaancccaaaagtccngatctctgccgcctctactttgacaaaggtcggggtccatctaaggttcagccggcagtggatcgtgggacagtaattcacgttctacaccatcatcagcctgcagtcctagacgtatttcgactaacttactactcgactaaggtcactaataactaatctaagtttcgggacggtaagggacctaagggtcgaagactaacaaaacgaactgcggtactcggcacactctagttcctactacgttccc

SEQ ID NO: 401188 - DNA, 561 bp, Homo sapiens
  misc_feature: GZ8MTXP02HOSJG.15.28.C06.1.454.CMB.2.raw
  modified_base (254)..(254): a, c, t, g, unknown or other
  modified_base (368)..(368): a, c, t, g, unknown or other
  modified_base (451)..(451): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctactctggctcccaggtgccaaatgtgacatccagatgacccagtctccgtccaccctgtctgcatctgtcggagacagagtcaccatcacttgccggcagtcagagtattaactaatggtgcctggttnagcagaaaccagggaaacgaccccaaaagtcctagatctctcgccgcctctacttgacaaggtgggtacccatcaaagttcaggcgccagtgatcgtggacagattacagtacncaccatcagacacggcctagacgacgtcccgtagtaccgttatttacgacctaacctttacgtaacctcggactaacggttanactaataatatacgtaggtacggacggacggaacgaggtagaacgtacgtaacgaaacgacgtcggtacgtcgtacgactaacgtctacgtctacctctaccttccgtcc

SEQ ID NO: 401189 - DNA, 695 bp, Homo sapiens
  misc_feature: GZ8MTXP02FMXPE.15.28.C06.1.454.CMB.2.raw
  modified_base (198)..(198): a, c, t, g, unknown or other
  modified_base (292)..(292): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagacgtccaccatcacgttcggccgggcagtcagagtattaactaagtggttgctgttcagcagaacgaggaacacccaaagtcagactctntcgccgtctctacgtttgactaaaggtcgggtaccagtacgaggttcacgcgcgagtcggatcggagggacagtaactcgtagtcctacacctactacgacgacgtaccggccttacgaccgtaacgtcccgtagtaaccgtttacgtttaccggaaccttaaaccgtttacggtaactaccgggtaaaccctaaggttaccggtaaacttaaatttaaaccgttaacgttaccgtttaacggggtttaccgggaaacgggggtaacccgggtaaaacgggtaaacggggttacggaaaacggtaaacgttaaaaccgggtaaaacgttaccggtacggttacgggcttaacccggaactaccggtacttacggttctttaacccgcgttaccctttacccgg

SEQ ID NO: 401190 - DNA, 624 bp, Homo sapiens
  misc_feature: GZ8MTXP02GJ10C.15.28.C06.1.454.CMB.2.raw
  modified_base (199)..(199): a, c, t, g, unknown or other
  modified_base (255)..(255): a, c, t, g, unknown or other
  modified_base (257)..(257): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagacgtcaccatccacttcggccggcagtcagatattactaatggtgctgttcngnagaacaggaacacccaaagtccagactctctcgccgtcctctacgtttgacgtaaggtcgggtccatacgtaaggtcacggccgcgtagtggagtcgtagggactagtaacttcgacgttcctacactactcagcacggtccagacacgacgtgtacgttatttacgaccttaaacctttactacgtacgtaccgtaagtacgaacttaaattaaacttaacgttacttaacggggttaccggggaggggtaaaccggggtaaccggtaaggggtacggaaacgtttacgaaacggtaaaacggtacgttggtacggacgttcgaaccgtacgtactttcggtacttccttaacgtcctttaccccg

SEQ ID NO: 401191 - DNA, 654 bp, Homo sapiens
  misc_feature: GZ8MTXP02HFZF6.15.28.C06.1.454.CMB.2.raw
  modified_base (199)..(199): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctgtcgganacagacgtcaccatcacttggccggcagtcagagtattactaagtggtagctgttcagcagaacaggaacacccaaagtcctagactctctcgccgtcctctacgtttgacgtaaaaggtcggggtaccatacgtaaggttcgacgtccggacgtaggtgacgttcggtaggggaacctagtaacgttcaacgttccaccactataccagcacggcctggaccacgtaccgtacgtacgttagtttacgacttaaaccttaccgtaactcggtaacccttaaggtcaactaaattaaacgtaacgtacgttaacgggtttaccgggaccggggttaaacgggaaaccgggtaaagggttaacggaaacggtaactaaaccggaaaacgttacggtacggtacggttaccacgtaacctaaactcgttacgttcgttcctaacttccgtttccccc

SEQ ID NO: 401192 - DNA, 612 bp, Homo sapiens
  misc_feature: GZ8MTXP02FQC7V.15.28.C06.1.454.CMB.2.raw
  modified_base (312)..(312): a, c, t, g, unknown or other
  modified_base (372)..(372): a, c, t, g, unknown or other
  modified_base (513)..(513): a, c, t, g, unknown or other
  modified_base (521)..(521): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgacgctacttattggatgtacttggggtccnccgaggctccgaaggggaaggggctgggagtgggtcggccaaccgaataaacaaaaaagntaggaaacgtgaacaacaaacctagtgtagactctgtagagtcggggactattccacccgtctccctcaacgccctacccaccacgggcccagtccggtcccttccccgtggcccgccctagcctccgacggacgccaccnccgagacncacgtacgccggccctgggcctacggccgtacggtacgaaacggtccttaccgtcccgtacgtaacggtacgacgtacggacggccggacg

SEQ ID NO: 401193 - DNA, 509 bp, Homo sapiens
  misc_feature: GZ8MTXP02FMP5D.15.28.C06.1.454.CMB.2.raw
  modified_base (363)..(363): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaacccaggggaaaagcccccaaaaagtcctgatctctgccgcctctactttgcaaaagtggggtcccatcaaggttcagccggcagtggatctgggacngaaattcagtctcaccatcagcagcctgcagccctgacgattttgcaacttactactgccaaagtgcataataatcaatttcggcggaggggaccaaggtggagatcaaaacgaactagtggctgcaccaatctgtcttcattccc

SEQ ID NO: 401194 - DNA, 680 bp, Homo sapiens
  misc_feature: GZ8MTXP02IXI87.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagatcaccatcacttgccggccagtcagagtattactaagtggtgtctggttcagacaagaacgaggaaacgaccccaaaagtcctagatctcgtcgcccgtcctcttacgtttgacgtaaaggtcgggtaccatacgtaaggtcagccggacagtgatcgaggaacagtacttcagtcctaccacatacacgcacgcctgactacgccgttaggtaacgttacgtttacgaaccttaaactttaaccgtaaccgttacgaacccgttaaaggtacccgtaataaacttaaaactaaccgttacgttaacgggtttaccggggaaccggggaaacggggtaaaccgtaaaggggttaacgggaaaacgttaaacggtaaaccgtaaaaaccggtaacggtttacgggacgtaccgttaacggaacccgtaacgttaacttccggtttacgttaccgtttacgttaacccgtttacccccg

SEQ ID NO: 401195 - DNA, 715 bp, Homo sapiens
  misc_feature: GZ8MTXP02GCZYZ.15.28.C06.1.454.CMB.2.raw
  modified_base (127)..(127): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctntggctcccaggtgccaaatgtgacatccagatgacccagtcctccgtccaccctgtctgcatctggtcggagacagagtccacatcacgttcggccggcagtcagtagtaattactaagtggtgtcttggttcagacagaaccgaaggaacgacccgaaagtcctagactctctcgccgtcttctactttgactaagggtcgggtaccctagtacgtaacggttcaggaccccggtcgtaaggtggtaagtcggtagggaaactaggtaacttactaacggtcctaccaaccgaattccaaaggtacctacgtaccccgtggacctaaccgggtcccttaggtaacggttactttacgtaccgtaaaacctttaccgtaacgtcgaaacccgtaaaggtacgaacctaaaagttaaactaaaattccggtttaaggtttccgggggaacggggtaaacggggtaaccgtaaacgggggttaagggaaacgttaaactaaaccggtaaaaacggttacggtggttaaacggtccttacggaaccctaaacggtcttacgttactttaccgttactaccgtttacccccg

SEQ ID NO: 401196 - DNA, 602 bp, Homo sapiens
  misc_feature: GZ8MTXP02IEBIY.15.28.C06.1.454.CMB.2.raw
  modified_base (266)..(266): a, c, t, g, unknown or other
  modified_base (355)..(355): a, c, t, g, unknown or other
  modified_base (416)..(416): a, c, t, g, unknown or other
  modified_base (501)..(501): a, c, t, g, unknown or other
  modified_base (535)..(535): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttcctgttgctattttagaggtgtccagtgtgaggtgcaacgtggtggagtcgtgggggagcctcgtccgaggccggggggtccctgagactctcctgtgagcctntggattcaccttgagcacttatgatgacttggtcccgcgaggcctcgaggggagggcgtggaggtggtcggccacataaacgaaaaagntaggaagtacaacacaacctagtgtagtactcgtgtcgagtcgggcctatcgacccgttcncctcacgccctacccgaccgacgggccctacgtcccggttccccttcccccgtcggcccgtccccgtcgcctcccgaagggaccnccgaccctccggagacgacacgacggccgcccgngggctacgccgtaggcgaacggtaccttaccgtccgtactaacggtacgaaccgtggcggtcgggcg

SEQ ID NO: 401197 - DNA, 543 bp, Homo sapiens
  misc_feature: GZ8MTXP02FT36N.15.28.C06.1.454.CMB.2.raw
  modified_base (466)..(466): a, c, t, g, unknown or other
  modified_base (528)..(528): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaacgaccccaaaagtcctgatctctcgccgcctctactttgacgtaaaggtcggggtcccatcgaaggttcaggccggcagtgatcgtagggacagattcagtctcacatcagcagcctgcagcctgacgtattttgactaacttacgtactgacccgtaagtcgactaataaactaatctaagtttaccggggnggaagggtaccaaaggggtcgtaagatacgaaaacgtactggtacggctagcctacatcgtntcttctactttcccg

SEQ ID NO: 401198 - DNA, 546 bp, Homo sapiens
  misc_feature: GZ8MTXP02IRCFP.15.28.C06.1.454.CMB.2.raw
  modified_base (251)..(252): a, c, t, g, unknown or other
  modified_base (282)..(282): a, c, t, g, unknown or other
  modified_base (327)..(327): a, c, t, g, unknown or other
  modified_base (359)..(359): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtcaccctgtctgcatctgtcggagacagagtcaccatcacttgccgggccagtcagagtattactaatggtggctgttnncagaacaggaacaccccaaagtcctgatcnctgtcgctctcttgacgaagtcgggtccatcgagttcagccggcngtgatctgggacaggattcacgtctcactacncacgcacgctgacgcgcgtacggtacgttagtttacgacctaacttacgtactacgactagtactactaataaagtatacgtaggttacgggacgggacggtacgaagggtcggtagacgtaaacgaaacgtacgtacggtcgtactacgaaccgtactacgttcgtcgttaccttacactttcccg

SEQ ID NO: 401199 - DNA, 549 bp, Homo sapiens
  misc_feature: GZ8MTXP02HX4R4.15.28.C06.1.454.CMB.2.raw
  modified_base (265)..(265): a, c, t, g, unknown or other
  modified_base (401)..(401): a, c, t, g, unknown or other
  modified_base (422)..(422): a, c, t, g, unknown or other
  modified_base (431)..(431): a, c, t, g, unknown or other
  modified_base (445)..(445): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccacctgtctgcatctgtcggagacagagtcacatcacttgccgggccagtcagagtattactaatggtggcctgttcagcgaaacaggaaancccaaaagtcctgatctctcgccgctctactttgacgtaaaaggtcgggtaccctatcgaaaggttcaggcggcctaggtgatcgtagggaacaggacttacgagtctcgaccatcagcagcctgcagcctgactntttcgactaacttacacgttnacctaagtnactaataattaaanctaagtttcgggcgggaacgggaacctaaggggtaggaagtaaactacgaaaacgtacgtagtcggactcgacaacacgtctcgtactctaacttccctacccg

SEQ ID NO: 401200 - DNA, 619 bp, Homo sapiens
  misc_feature: GZ8MTXP02IPB60.15.28.C06.1.454.CMB.2.raw
  modified_base (328)..(328): a, c, t, g, unknown or other
  modified_base (566)..(566): a, c, t, g, unknown or other
  modified_base (594)..(594): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtcctgcatctgtcggagacagagtaccacctatcctacttcggccggaccagtcagtaagttaattaacgtaaagtggttacggtccgttggtttacagacaaacggaaaccgaacggaaacgaaccccgaaagtcctagacttcncgtcgccgtcctactcgtttacgacgtaaagggtcggtacctgtacgtacgttcgacgcggactagtggtatcggtgacagtatcacgtctacctacaatcaacgcgtaacgtcacggactacgcccgtaaggactttagtttcaaaccttacttaaacgttacacgtaaccgtagtaccgaataactaaattacgtacttaacggttccggaagggtacggaaacgtacgggagaancgtaaacgaaacgtagttcgagccgtanaacgactctctcgtactctactccg

SEQ ID NO: 401201 - DNA, 760 bp, Homo sapiens
  misc_feature: GZ8MTXP02HYHGY.15.28.C06.1.454.CMB.2.raw
  modified_base (195)..(195): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccacctgtctgcatctgtcgganacagagtcacatcacttggccgggccagtcagtatattactaaagtggttggcctggttcagcaagaaaccgagggaaacgaccccaaaagtcctagatctctcgccgcctctactttgactaaagggtcggggtacccatacgaaaggttcgaggtccggcaggtggatcgtaggggaacagtaaacgtttcgacgttcctaccaaccattacccaggacccaagtcccccgtagcccgaacgtccccgttagggtaacccggtttaatttttaccgggaccctttaaaaaccgtttaaccctttaacccgtttacgggaaccccgttaaaaacgggtttacgtaaaccttaaaagtttaaaaacttaaaaccggttaccggtttaaaccgggtttaaccgggggaaccggggtaaaccggggtaaaaccggtaaaagggggtaacggtaaaacggtaaaccgtaaaaccggtaaaaccggtaacggttacgggtacggtaccgtacgaacccgtaaccgttaacgttccgttacgtttaccctttaccgttacccgttccccg

SEQ ID NO: 401202 - DNA, 576 bp, Homo sapiens
  misc_feature: GZ8MTXP02I274O.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggcctggtttcagcagaaaaccagggaaacgccccaaaaagtcctagaatctctgccgcctctacttgcaaaagtcggggtcccatcaagtcagcggcagtcgatcgtggacagaattcagtctcacatcagcaagccctgcagcctgacgtattttcgactaacttactactcgaccctaagtcgacaataaataactactaacgtttcggacggaagggtaaacccgaagggttagggaacgaaagtaccgaaaaacgtaaaccgtaggttacggccttaggaaccgaacctaacttcctaggtttccctttacgtaaactttccccg

SEQ ID NO: 401203 - DNA, 807 bp, Homo sapiens
  misc_feature: GZ8MTXP02FQPIS.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttcggccggcagtcagagtattactaagtggttgctggttcagacaagaaaccgaggaaacaccccgaaagtcctagactctctcgcccgtccttcttacgtttcgacgtaaacgggttccggggtaccctaagttaccgtaaaggttccgaacggtcccggggaccgtaaggggttacggggtaacgtttaccggtacgggggtaaacgtacgggttaaaacgtttaccgtaaacggtttacccctaaccgtaaacccctaacgttacccgaaaccggtacccgaaaccggtccccgttacggacccgtaaccggtaccccgttacgggttaaccggttttaactttttaccggaaacccttaaacccttttaaaccgtacccgttacggaaccccgtaaggttacgtaaaccttaaacttaaaacttaaaccgttaccggttaacgggtttaccgggggaaccggggttaaacggggaaccggtaaagggttaacggaacgtaaacgtaaaccgtaaaacggtaaccgtggttacggacctacgaaccgtaaccgtactttacgtcgtttacctaccttactttacccccg

SEQ ID NO: 401204 - DNA, 508 bp, Homo sapiens
  misc_feature: GZ8MTXP02ITI5L.15.28.C06.1.454.CMB.2.raw
  modified_base (252)..(252): a, c, t, g, unknown or other
  modified_base (277)..(277): a, c, t, g, unknown or other
  modified_base (282)..(282): a, c, t, g, unknown or other
  modified_base (288)..(288): a, c, t, g, unknown or other
  modified_base (299)..(299): a, c, t, g, unknown or other
  modified_base (342)..(342): a, c, t, g, unknown or other
tcagtctacgtagccacgaccggtgctcgatttagagctcacgtattgggtttggggggagtcagactcagtcaggacacagcatggacatgagggtccccgctcagctactggggctcctgctgctctggctcccaggtgccaaatgtgacatccagatgacccagtctccgtccaccctgtctgcatctgtcggagacagagtcaccatcacttgccgggcagtcagatatactaatggttggctgttcngcagaacaggaacgccccaaagtcngatcnctgccncctctactttnacaaagtgggtccatcaaggtcagccggcagtgatcgtggacngaattcagtctcacatcagcagcctgcacgctagacgtatttcgactaactttactacttagacctaagtcgacaattaaatatctaagttcggacggaaggacgaagggtagagaatacgaaacgacgtcgtggcctagcaacctcttcgtattctactactccg

SEQ ID NO: 401205 - DNA, 536 bp, Homo sapiens
  misc_feature: GZ8MTXP02J2V4I.15.28.C06.1.454.CMB.2.raw
  modified_base (253)..(253): a, c, t, g, unknown or other
  modified_base (265)..(265): a, c, t, g, unknown or other
  modified_base (276)..(276): a, c, t, g, unknown or other
  modified_base (282)..(282): a, c, t, g, unknown or other
  modified_base (326)..(326): a, c, t, g, unknown or other
  modified_base (339)..(339): a, c, t, g, unknown or other
  modified_base (356)..(356): a, c, t, g, unknown or other
  modified_base (360)..(360): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagacgtcacatcacgttgccggcagtcagatattactaagtggtgctgtcancagacaggaacnccaaagtctanatctcncgccgctctagtgacgaaggtcggtaccatcgagtcagtccganagtgatgaggacngactcagtcacacctancacncgacgcgcgacgcgcgtcgtacgttacgttactactactactacgtacgacgtagtactactaataatacgtacgtacggtacggacggtaacggtacgtaggtacgacgacgtaacgtaaacgtcgtacgtacgtacgacgtaacgtactacgtacgtcgttactactacgtccg

SEQ ID NO: 401206 - DNA, 614 bp, Homo sapiens
  misc_feature: GZ8MTXP02H4S8V.15.28.C06.1.454.CMB.2.raw
tcagtctacgtagccacgaccggtgctcgatttagagctcacgtattgggtttgggggagtcagactcagtcaggacacagaatggacatgagggtccccgctcagctcctggggctcctgctgctctggctccaggtgccaaatgtgacatccagatgacccagtctccgtccacctgtctgcatctgtcggagacagatcaccatcacttgccgggcagtcagagtattactaaagtggttagcctggttcagcaagaaaccagggaaacaccccaaaagtcctagactctctcgcccgtcctctaactttgacgtaaaacggttcggggtacccagtacgaaaggtttcaaggcggaccgaggttagggaacttcggtagggactaaggaactttccgaaagtccttacaacccaatcaaacacacgtctacgacgacgacgtacgtacgtacgttacgtactacttactactacgtacgtagtagtataataataatactacgtacggacggacggtacggaacggtaggacgtaacgtaacgaaacgtaacgtacgtacgtacgtacgacgtaacgtactacgttacgttacttactaccttacctccg

SEQ ID NO: 401207 - DNA, 578 bp, Homo sapiens
  misc_feature: GZ8MTXP02HMW8B.15.28.C06.1.454.CMB.2.raw
  modified_base (203)..(203): a, c, t, g, unknown or other
  modified_base (210)..(210): a, c, t, g, unknown or other
  modified_base (253)..(253): a, c, t, g, unknown or other
  modified_base (440)..(440): a, c, t, g, unknown or other
  modified_base (533)..(533): a, c, t, g, unknown or other
  modified_base (550)..(550): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagngtcaccntcacttgccggcagtcagtatataactaatggtgctgttcagnagaacaggaaacaccccaaaagtcagatctctgtccgcctcttacgtttgacgtaaaaggtcggggtacccagtaccgtaaggtcgagtaccggactagggtgacgtcgtaggggaactaggtaacttcagtcctacaaccatacgacgacacggtcctagacgacgtcctaggtacttaacgtttnaccttaacttactacgtacgacctagtcactaataatactactaggttacggacgggtaacggacgaaggtaggatagtaacgaaacgtacgngttacggcttagaaccncgtattctacgtacttcgactttccccg

SEQ ID NO: 401208 - DNA, 666 bp, Homo sapiens
  misc_feature: GZ8MTXP02IRQLN.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaagtggttgcttgttcagcaagaacgaggaaacgaccccaaaagtcctagactctctcgcccgtcctacttactttggaccgtaaaagggtcggggtacccagtacgtaaggttcaggcccggctaggtgatcgaggaacagtaattcgagtcctacacatcgacgacacgtccgagcgacgccgtagtacgttattttacgaccttaaactttacctaacgttccgaaccgttaaaggttcgaacttaaacgttaaaactaacgtttaccgttaacggtttaccggggaacggggtaacggggtaaaccgtaaagggggttacggaaacggtaacgtaaaccggtaaaaacggtacggttacgggttacggaccgtacggaacccttaccggaactttccggtcgttaccttcgttacctttccccgg

SEQ ID NO: 401209 - DNA, 649 bp, Homo sapiens
  misc_feature: GZ8MTXP02ICS6L.15.28.C06.1.454.CMB.2.raw
  modified_base (286)..(286): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttggccgggccagtcagagttattaactaagtggtggcttggtcagcagaaacgaggaacaccaaagtccngatctcgtcgccgtctactacgttagacgtaaggtcggtaccatacgtaaggtcgacggcccgacgtaggtggacgttcggtacggactagtaacttacgtacgtcctaccgacctatacgacgacgaccgtccgtcgacgaccgtcgtacggtactttaacgttaccaccttaaaaccttacgtaccgttacggaccttaagtacctaataaattaaacttacgtaacgttaggttaccggggacggtaaaccggggacgtaaaagggtaggaacgttaacggaaactaaaccgggaagttcggacgggtacctacgaaccgtaactacgtttcgtacgtttccttacgtaccgtttccccg

SEQ ID NO: 401210 - DNA, 566 bp, Homo sapiens
  misc_feature: GZ8MTXP02F7LV9.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttgctggttcagcagaaaccaggaaacgaccccaaaagtcctagatctctgcccgcctctactttgactaaaggtcggggtcccatcgaaggttcaggccggacagtggatcgtaggggacagtaatcagtctacacatcagcagcctgcacgcctagacgtatttcgactaacttactactgaccaagtgactaaataaactaacgttactagtttacgggacgggtaacggggaccgaaaggggtacggaaggtataacgaaaacggtaacgtcggtaggctacggaaccgaacctatcgtcgttccttactactttccccg

SEQ ID NO: 401211 - DNA, 582 bp, Homo sapiens
  misc_feature: GZ8MTXP02IX091.15.28.C06.1.454.CMB.2.raw
  modified_base (199)..(199): a, c, t, g, unknown or other
tcagtctacgtagccacgaccggtgctcgatttagagctcacgtattgggtttgggggagtcagactcagtcaggacacagcatggacatgagggtcccccgctcagctcctggggctcctgctgctctggctcccaggtgccaaatgtgacatccagatgacccagtcctccgtccaccctgtctgcatctgtcgganacagagtcaccatcacttgccggccagtcagagtattactaatggtgctggttcagcagaacgaggaacaccccaaaagtcctagatctctgtcgtcctcttactttgacgtaaaggtcggggtacccagtaccgtaaggttcgagcccgggactaggtgagttcggagggaacaggtaattcgagtccacacatcagccagcctcgacacgtaccctgtaacttatttcgactaaacgtttacacttagacctaagtcgataaataaataactcgtagttcgggagtaacgggaactaagggtacggaagtaactaaacgaaaacgtacgtaggcggtactacgaactaccgtacgtctacgttcttaccgtatttcccccg

SEQ ID NO: 401212 - DNA, 539 bp, Homo sapiens
  misc_feature: GZ8MTXP02F9S67.15.28.C06.1.454.CMB.2.raw
  modified_base (359)..(359): a, c, t, g, unknown or other
  modified_base (421)..(421): a, c, t, g, unknown or other
  modified_base (423)..(423): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaaagtggggtccatcaaaggttcagccggcagtggatctgggacngaaattcagtctcacatcagcagcctgcagcctggacattttgacaactacactgcaaagtnanaataataatatagttacggacggaacgggaacggaaggtacggaaggaagtaacgaaaacgaaacgtacgtacggtacgacgaaccgaacctaactacttagttacttactactcc

SEQ ID NO: 401213 - DNA, 664 bp, Homo sapiens
  misc_feature: GZ8MTXP02I5VH4.15.28.C06.1.454.CMB.2.raw
  modified_base (455)..(455): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagacgtcaccatcacgttcggccgggccagtcaagtacgttattaacgtaaagtggttcggtccgttggttacagacgaaacgaaaccgaagggaaacaccccaaaagtcctagactctctcgaccgtcctcttacgttgacgtaaaggtcggggtaccctagtaccgtaggtcacggcccggagtacggtggtaatcggtacggggaactaggtaacttcacgttccaccgaacctagtaccaacgtcgaacnccgtcggaccgtacgccgttacggacgtttacgtttacgacctttaaaccttacgtaacctcgaccgtaagtctactaataatacttagtacggttacgggacgggtacggtaacggaagggttaggaataacgtaacgtaaaaccggtagtacggtcggtactacgtaacctacgtacgttctaccgtttactactaccgtttccccg

SEQ ID NO: 401214 - DNA, 575 bp, Homo sapiens
  misc_feature: GZ8MTXP02IG2AR.15.28.C06.1.454.CMB.2.raw
  modified_base (383)..(383): a, c, t, g, unknown or other
  modified_base (408)..(408): a, c, t, g, unknown or other
  modified_base (412)..(412): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtcctgcatctggtcggagacagagtcaccattcacttggccggcagtcagagtattaactaagtggttgcctggtttcagacagaaacaggaaacgaccccaaaagtcctagatctctgtacgcctactactttgctaaaaggtcgggtacccagtacaacggttcagccggacaggtgattcgagggacaggtaactttnacgttcacacgatcaagcagtcccncgcncgcgtcgtacgtacttactactactactactacacgtagtatactaataactactacgtacgtacggtacggacggaacggtacggtacggtacgaacgtaaacgtaaacgtaacgtacgtacgtacgacgaacgtactactactacttaccttactactccg

SEQ ID NO: 401215 - DNA, 548 bp, Homo sapiens
  misc_feature: GZ8MTXP02FTKZ2.15.28.C06.1.454.CMB.2.raw
tcagtctacgtagccacgaccggtgctcgatttagagctcacgtattggggtttggggggagtcagactcagtcaggacacagcatggacatgagggtcccgctcagctcctggggctcctgctgctctggctcccaggtgccaaatgtgacatccagatgacccagtctccgtccaccctgtctgcatctgtcggagacagagtcaccatcacttcgccgggccagtcagagtatactaaatggtggctggttcagcagaaaccaggaaacgaccccaaaagtcctagactctctcgccgccttctactttgactaaaggtcggggtaccatacgaaggttcagccggcagtggatcgtagggacagtaatcagtctcacatacagcagtcccagcacgtcctagtaacgttattttcgaactaaacttactactacgaccgaagtcactaaataaataatctagtttacggcggaagggaccgaagggtcgagatacgaaaagtacgtgtacgctgaacactacttctcgttactactacttcccg

SEQ ID NO: 401216 - DNA, 568 bp, Homo sapiens
  misc_feature: GZ8MTXP02HPI7A.15.28.C06.1.454.CMB.2.raw
  modified_base (196)..(196): a, c, t, g, unknown or other
  modified_base (249)..(249): a, c, t, g, unknown or other
  modified_base (251)..(251): a, c, t, g, unknown or other
  modified_base (260)..(260): a, c, t, g, unknown or other
  modified_base (268)..(268): a, c, t, g, unknown or other
  modified_base (277)..(277): a, c, t, g, unknown or other
  modified_base (280)..(280): a, c, t, g, unknown or other
  modified_base (315)..(315): a, c, t, g, unknown or other
  modified_base (354)..(354): a, c, t, g, unknown or other
  modified_base (505)..(505): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtcctccgtccacctgtctgcatctgtcgganacagagtcaccatcacttgccggcagtcagagtatataatggtgctgttcagnanaacaggaanccaaatcnatctctgcnctntactgacaagtcggtccatcgaagtcaggtccganacgtgacgtcgtaggggaacagtaacttcaacgtcctanaacccattccaagtcaacggtccctagccacgtacctacgacggttaattttcgacttaaacttaacctacgtagtacctaaaggttacactaaaattaactaaagtactaacggttcgggacggtacggaaaccgaagggtagaaagtanaaaccgaaaggtaacgtggtacgtgacgaacgtaacacgttctaacgttctaacctcttcccg

SEQ ID NO: 401217 - DNA, 730 bp, Homo sapiens
  misc_feature: GZ8MTXP02JSB93.15.28.C06.1.454.CMB.2.raw
  modified_base (201)..(201): a, c, t, g, unknown or other
  modified_base (298)..(298): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctggtcgganacagatcaccatcacttcggccggcagtcaagtatattaactaagttggttggctggttcagacaagaacaggaaacacccaaagtcctagatctcncgcccgcctacttacttcgactaaacgggtcggggtacccagtaccgaaggttcgagccggcgtaggtggactcggtagggactaggtaacttacgacgttcctacgtaacccagtacccgaacgtacccgaacggtcccgtacggccgaaccggtacccgttacggtaaccgtttaaggtttaccaaacccgttaaaactttaccgtaacgttaccgaaaccgtaaagtacgaacctaaaattaaaacttaaacttacgttaacgggtttacccgggggaagggtaaaccggggaaaccggtaaaagggggtaggtaaacgtaaaccgtaaaccggtaaaacggtacggttacggtacccggtacgttacgaacccggtaacctacgtttacgttacccggtttacctttaccctaccgttttaccccccg

SEQ ID NO: 401218 - DNA, 837 bp, Homo sapiens
  misc_feature: GZ8MTXP02IZHJ0.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatcgtggtcggagacagagtcaccatctacttcggccggccagtcagtagtattactaagttggttcggtccttggttcagacgaacggaaaccgagggaaacaccccgaaaagtcctagatcctacgtcgcccgtccttaccttactttacggacgtaaacgggttcggggtaccctaagtacgtaaacggttcgacggccggacgtaaggtggtacgttacggacggggtaaccaggttaacgttaccggtacgttccctaccaacccgtataccgtaacggcctaaccggtcccttaacggcctacccggtacccgttacgggttaacccgttttaagttttacccggaacctttaaaccgttttaaaccgttacccgttaccgtaaaccggttaacgggtttacgtaacccgttaaaatttaaaacggtttaacgtttaccggttttaaacgggggtttacccgggggaaaccgggggtaaaccgggggttaaaacccgtaaaacggggggttaaggtaaacggttaaaaccggttaaaaccgaaaaaacggggttccggttaagggtaccgggtaaccgttcgtaaaacccgtccttaacggtttcctacggttttacccttccgtttaaaccccttttcccccg

SEQ ID NO: 401219 - DNA, 786 bp, Homo sapiens
  misc_feature: GZ8MTXP02G88T0.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattactaaagtggttggccttggttcagcaagaaaccgagggaaacaccccgaaaagtcctagactctctacgcccgccttctactttacggacgtaaaacgggttccggggttacccagttacgtaaacggtttccgaaggccccggggtactaagggttacgggaacgttaccggttacgggggaactaggggttaaactttacgaacggtttaccctaccgaaacccgtaaacttcccgaaacggcccttaaaccggcccgttacgggacccgtaacgtcccggtttaacggtaaaccggtttaacgtttttacgggaaccctttaaaccttttaaaccgttaacccgtaccggtaacccgtaaagggtttcgaaaccttaaacttaaaagttaaaccttacgttaacggttttacgggggaccgggttaaacggggaaacccgtaaagggttacggacgttaaacgaaaccgtaaaaccggtaacgtcggtacggccttaggaacctaaccggtaacgttcctcggtttacctttacgactttccccg

SEQ ID NO: 401220 - DNA, 684 bp, Homo sapiens
  misc_feature: GZ8MTXP02H5E07.15.28.C06.1.454.CMB.2.raw
  modified_base (665)..(665): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccacctgtctgcatctgtcgagacagagtcacatcacgttcggccggcagtcagagttattaactaagtggtggccgttggttcacgacaaacgaaaccgaacggaaacgaccccgaaaagtcctgaactctcgtcgcccgtcctacttactttcgacgtaaaaggtcggggtaccctagtaccgtaaggttacgagtccggacgtagggtagtagtcggttaggggaacaggtaaacgtttctaacgttaccttaaccaacctaactccgaaacgccgaacggaccctcgaccgaacgtcccgttaacgacccggtttaagttttacaccttaaaaccttaccgttacgtacgaaacccgttaaggtacgtaacctaaattaaagtaaacttcgaaacggttttccggggaacggttaacggggaccgtaaaggggtagaaagttaccaaagtaaacgaaacgtgtaacgcgtacgaacgactacgttcgtnttacctcgtaacttccccg

SEQ ID NO: 401221 - DNA, 622 bp, Homo sapiens
  misc_feature: GZ8MTXP02IYZL7.15.28.C06.1.454.CMB.2.raw
  modified_base (313)..(313): a, c, t, g, unknown or other
  modified_base (366)..(366): a, c, t, g, unknown or other
tcagtctacgtagccacgaccggtgctcgatttagagctcacgtattgggtttgggggtcagagaggagccttagccctggactccaaggcctttccacttggtgatcagcactgagcacagaggactcaccatggaattggggctgagctgggttttcctgttgctattttagaaggtgtccagtgtgaggtgcaactgggtggagtcgtgggggaggccctcgtccgaggcccgggggggtccctggagactctccgtgtgaacgcctcgtggattcaccttgagcacttattggatgtacttcgggtccncaggcctccgaggggaaggggctgggagtggggtacgccaccataacaaaagngtaggaagtgaccacaacctatagtgaaccttcgtgtgagtcgggcctattccaccgtctcccagacgacgacgaccaaagactacactacatctagactaaatacgaaactaaccgtaggaagaccggaccggaaggtacgaacggtcttggtagtaatttcgtaggttgtaggaggtatagttcgtttcgtcggggtaccggttcgggggaccgtacggggtacccgtcggtaccctaccggtctttaccccgg

SEQ ID NO: 401222 - DNA, 620 bp, Homo sapiens
  misc_feature: GZ8MTXP02GZYO6.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtggcctggttcagcagaaaccagggaaacgccccaaaagtcctagatctctcgccgcctctacgtttgacaaaaggtcggggtcccagtacgaaaggttcacggccggacaggtggatcgtggggactggaattcaggtctcacatcaagtcaagcctgcagcctgaacgtatttacgactaacttactactgacctaagtcgaactaataaagtaacttacgtaacgtttaccgggggacgggtaaaggtacccggtaaagggttagggaaccgtaagtaaacccgtaaaaacgaaaccgttgggtaccgggtacctaacggtaacccgtaaaccgtactttaccgtacgttacctttacgaaacttttcccccgg

SEQ ID NO: 401223 - DNA, 705 bp, Homo sapiens
  misc_feature: GZ8MTXP02IEYEI.15.28.C06.1.454.CMB.2.raw
  modified_base (198)..(198): a, c, t, g, unknown or other
  modified_base (276)..(276): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccacctgtctgcatctggtcgganacagagtcaccatcacttgccggcagtcagtagtattaactaagtggttgccttggttcagcaagaaccgaggaaacnccccaaagtcctgatctctgcccgtctcttactttgacgtaaacggtcggggtacccatacgtaggttcgaggccgactaggtggactcgtacgggatacggtatttacgacggttacctacctaacccgtactaccgacgtacgacggtccgtacgaccgtaccgttaccgttacgttaacggtttaacgttttaccgtaaccgtttaaaccgtttaccgttaaccgtacgtaaaccgttaagttaccgtaaacttaaagttaaacgttaaaccgttacggttaacgggttaccggggacgggtaaaccggtaaacgggtaaggttaacggaaacgtaaacgtaaaccgtaaaacggtacgtacggtacggtacctacgaaccgtacgtacgtttaccgtacttccgttaaccttacccggtaccccg

SEQ ID NO: 401224 - DNA, 602 bp, Homo sapiens
  misc_feature: GZ8MTXP02G83W5.15.28.C06.1.454.CMB.2.raw
  modified_base (195)..(195): a, c, t, g, unknown or other
  modified_base (386)..(386): a, c, t, g, unknown or other
  modified_base (388)..(388): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccacctgtctgcatctgtcgganacagagtcacatcacttcgccggcagtcagtagtaattactaaatggttgtctgttcagcagaaacaggaacaccccaaaagtcctagatctcgtcgccgtctactactttgacgtaaaaggtcgggtacccatacgaagttcaggccgcagtgatcgagacagaatcagtcctacacactcgaagcaacncncgacgacgtcgtacgtacgttacttacgtacttaacttaactacgtacgtacgtaacgtacgtaactaaactaaattaacgttacgtacggttacgggacgggtaacgggtaaacgtaacggtaacggtaacgtaaacgtaaacgtaaaacgtaacgtacgtacgtacgtacgaacgtacgtacgtacgttacgttacttaccgtaccgtaccg

SEQ ID NO: 401225 - DNA, 641 bp, Homo sapiens
  misc_feature: GZ8MTXP02HKP1Z.15.28.C06.1.454.CMB.2.raw
  modified_base (202)..(202): a, c, t, g, unknown or other
  modified_base (454)..(454): a, c, t, g, unknown or other
  modified_base (490)..(490): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctggtcgganacagacgtcaccatcacttggccggccagtcagagtattactaagtggttcgccttgttcagacaagaacgaggaacacccaaagtcctagatctactcgcccgtccttactactttgacgtaaagggtcgggtacccaagtccgtaaaggttcgaaggcccgggacgtaggtaggtacgtcggtacggggaacaggttaacttcgacgttccaccaactatccagctaacggcctggactacgtaccgttntaacgttacgtttcaaccttaacgtttactacgttnaccgtagtcactaaataactaatcgtaagtttccggggaggtaacggaacgagggtagaacgtactaaaaccggaaaacgtcgttagggacggttcctacggaaccgtacccttaaggttccgtactttaccctcttaaccgtttccccgg

SEQ ID NO: 401226 - DNA, 772 bp, Homo sapiens
  misc_feature: GZ8MTXP02IRKVG.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttggccggccagtcagtagtattactaatggttggccttgttcagacaagaaaccgaggaaacgaccccaaaagtcctagatctcgacgcccgtccttctacgtttacgacggtaaacggttccggggttaccctacgtacgtaacgggttacgacggtcccggggacgtaggttagaggttacgttacggggaacctagggtaatttaccgtacgttaccttaccaacctacgtccgagacaccgtccgtacgcgtaacgtcgttacgtaacggttaagttttaccggacttaaaaccccttttaactaacccgttacgtaaaccccgttaaaggttacccgtaaattaaaccttaaaaggtttaaactacccggtttaaggggtttaacccgggggaacggggaacgggtaaccggggtaaacggggttaacgggggaaacttaaaccgtttaacccggaaaaacggtaccggtttagggtaccggaacggttcaacccggttaacccgttactttacccggttacgtttaccctttccgtttaaccgtttcccccg

SEQ ID NO: 401227 - DNA, 589 bp, Homo sapiens
  misc_feature: GZ8MTXP02J17WK.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagagtcaccatcacttggccgggccagtcagagtattactaagtggttgcctggttcagcaagaaacgaggaaacaccccaaaagtcctgatctctcgcccgcctcttacgtttcgacgtaaaagggtcggggtacccaagtaccgtaaaggtccgaggtccccggacgtaggttacgggtaactcgtaggggaactaggtaacttcagtctacacctatccagcagtcccgtagcacgctcgaacgttactttgactaaactttcctacgtcgtaccaaggtctactaattaattaactacgtaggtttcgggaccgggaaggtaccgaaggtaggagtacaacgaaacgtagtcgcgagcgtcactctctcgtctactactcccg

SEQ ID NO: 401228 - DNA, 727 bp, Homo sapiens
  misc_feature: GZ8MTXP02JWN22.15.28.C06.1.454.CMB.2.raw
  modified_base (202)..(202): a, c, t, g, unknown or other
  modified_base (661)..(661): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatcgtggtcggganagagtcaccactactactacgtcggccgactagtacgagtaattaacttaaacgtaggttgggtcgtcggtttgtacacgaacgaaaccgaaaccggaaaacccgaaaaccgtaagtcctagtactccgtacgccgtccctacgttacttacgtacgaagtaacggggtcccgtactacgtacggttacgtacgcggaccggtacgtaggtggtactacggggtacgaacgtaagttacctcggtacttacccacctaccgttacaccggtacacgtaacccgtccggacaacggtcccgttaacggtacgttaacgtttacgttaccaaaccgtttacttaccgtacggtacccgtaaagtcgtactaaataaacttaaataccgtacggttttaacggggacgggacgggaaaccggtaggtaagggtagacgttaaaacaccggttaaaaccgggnggtacggtacgaccgtaccgactaacgttctacgttaccttaccgtaccgttacccgtaccgtccg

SEQ ID NO: 401229 - DNA, 623 bp, Homo sapiens
  misc_feature: GZ8MTXP02JZ33Q.15.28.C06.1.454.CMB.2.raw
  modified_base (372)..(372): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccgggccagtcagtagtattactaatggttggcctggtttcagtcaagaaaccgagggaaacgaccccaaaagtcctagatctctcgcccgcctctctttagcaaaggtcggggtcccaagtcaaggttcaggccggcaggtggatcgtggganacggtaatcagtctacaccatcagacagccctgacacgtcctagacgttattttcgactaaactttacctactacggtaccaaaggttctactaaattaacgtaaaacgttccgaagtttttcgggggaaccgggtacggggtaaaccgaaggggttacggaaggtaactaacgtaaaaacccggtagttaccggtaggaccgtaggtaaccaacgttaactcgttaccgttcttaccgttacttcccccg

SEQ ID NO: 401230 - DNA, 611 bp, Homo sapiens
  misc_feature: GZ8MTXP02FQ5IE.15.28.C06.1.454.CMB.2.raw
  modified_base (347)..(347): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggagcctcgtccaggccggggggtccctgagactctcctgtgaagcctctggattcaccttgagcacttatggatgacgttcgggtccgcaggctccaggggaagggctggagtgggcgccacataacgaaaagngtaggaaagtgacccaacaacctatagtcgaaacttctggtagagtcggggacctaatttccgaacccggttcaccgagaacgacgaaccgaccaaagtaaccccaacgttacatacctagacaaactaacgaaacaaaccgacgaacgaacggacccggaacggaacgacggtacgtagtagtagttacgttacgtggtagtagtagtagttcgttgtcgtcggtcgggtacgacggtaaccggtcgtacgaccgtcgtcccg

SEQ ID NO: 401231 - DNA, 618 bp, Homo sapiens
  misc_feature: GZ8MTXP02FXGB6.15.28.C06.1.454.CMB.2.raw
  modified_base (297)..(297): a, c, t, g, unknown or other
  modified_base (463)..(463): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagttgacccagtctccgtccacctgtctgcatctgtcggagacagagtcaccatcacgttcggccgggccagtcagtagtattactaagtggtggcctgttcagcaagaaacgaggaaacacccaaacgtctagactctcncgccgtccttactacttgacgtaaggtcgggtccagtacgtagtcaggcggacgaggtcgagtcgtacggaacaagtatcgagtctacacctatcgagacacgtcctgaccagtcgtagtaccgttatttacgacttaaacttaccgtacgtacgacgtaacggtntaacctaaattaaactaacgtacgttaacgggttaccgggaacgggggtaacgggtaaaccgtaaggggttaacggaaacgtacgttaaaacgaaaacgtacggtacggtcgtacgtacgactaacctgtacgtcgtacttacgcttccctaccg

SEQ ID NO: 401232 - DNA, 646 bp, Homo sapiens
  misc_feature: GZ8MTXP02HK6H1.15.28.C06.1.454.CMB.2.raw
  modified_base (195)..(195): a, c, t, g, unknown or other
  modified_base (292)..(292): a, c, t, g, unknown or other
tcagtctacgtagccacgaccggtgctcgatttagagctcacgtattgggtttggggggagtcagactcagtcaggacacagcatggacatgagggtcccgctcagctcctggggctcctgctgctctggctcccaggtgccaaatgtgacatccagatgaccagtctccgtccacctgtctgcatctgtcgganacagagtcacatcacttcggccggcagtcagtagtaattactaagttggtggccttggttcagacaagaacgaaggaacacccgaaagtcagactcncgtcgcctcctacttacgtttcgaacgtaacggttcggggtacctacgtacgtaaggtcgacggtaccggacgtaggtcggacgttacggtacggggaacgacgttaacgtttcgtaaacggttccctaccctaaccacgtacgacgacgaccggttcgtacggacgaccgtaccgttacgtaacgtttatttacgacttaaccttaacgttactcgaacgtagtataactaataaactaacgttacgtaacggttcgggaacggaacgggtaacggtaaggtacgaagacgtaaacgtaaacgtacggtcgtacgtacgctaacgactactacgtcctacgttctacttcccg

SEQ ID NO: 401233 - DNA, 687 bp, Homo sapiens
  misc_feature: GZ8MTXP02GBIPN.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgcatctgtcggagacagagtccaccatcacgttgccggccagtcagtagtattaactaagttggtgtccttggttacagacaacgaaaccgtaagggaaacaccccaaaaggtcctagactcctctccgccgtaccttcgttactttggaaccgtaaaacgggttcggggtacccctaaattaccggtaaaggttccgaaggtccccgggtaacgtaagggttggaacttcggtacggggaacctagggtaaacttcgaaggtttcccacaacccgtatacgaacgccgaacgtccctaggacacgggtaccctggtaacgtttatttacgacctaaacctttaacgtaccgtacgacctaaggtactactaaataaacttagttaccttaacggtttacgggaacgggttaacggaacgtaagggtaaggaacgaagtaacgtaaaacgtagtacgtacgtcgtacgcgtaacctgtactcgtactaccgtacttccccg

SEQ ID NO: 401234 - DNA, 792 bp, Homo sapiens
  misc_feature: GZ8MTXP02JV342.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctggtcggagacagacgtccaccatcacgttcggccgggccagtcaagtagttaattaacgtaagtggttacggtcgttggttacagacgaacgaaaccgaaggaaaccgaccccgaaagtcctagactcctctccgtcccgtccttactacgtttacggaacgtaacgggttccggggtacctacgtacggtaacggttcgaacggtccccggtacgtagggtacggtaacgttccggtacggaacgtaggttacttacgtaaccgtacctaacccaaccgtacgtaccgacgacccgtaacgtcccgtaggaccgtaccggtaccgtacggttaaccgttacgttttaccggaaacctttaaaccgtttaccgtaaaccgttacgtaacccggtaagttacgtaacgttaaaagttaacttaaaccgttacgttaaccgggtttacgggggaacccggggttaaacgggaaaacccggtaggggtaaccggtaaaacggaaaccgtaaacggtaaaacccggttagtcgggtaccgtaccgtaacgtaaccgtaacccgtaacttcccggttactttcccgttaactccgtttacccccg

SEQ ID NO: 401235 - DNA, 629 bp, Homo sapiens
  misc_feature: GZ8MTXP02I3E86.15.28.C06.1.454.CMB.2.raw
  modified_base (359)..(359): a, c, t, g, unknown or other
  modified_base (441)..(441): a, c, t, g, unknown or other
  modified_base (536)..(536): a, c, t, g, unknown or other
  modified_base (574)..(574): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgcatcgtgtcggagacagagtccaccatccacgttcggccggccagtcagtagtattaactaagtggttcggtcgttggttacagacaaacggaaacgaagggaaccaacccgaaacgtcctgatcctcgtcgccgtccttactacgtttgaacgtaacgggtcggtacctanacgtaaggtcacgcggtcaggtgtagtcgtagggactagtacttcgacgtcctaccactatcgagaccacgtacctggaccngtaccgtacgtacttagtttacgaaccttaaacgtttacctacgtaccgaacgtagtaacaaccttaaataaacttacgtagttacggtacgggnggaaacgggtacgagggtacgagtaaacaaccgtaaanacgtgggtactcgtaacgtaaccaacgtcttacgtacgtccttactactttcccg

SEQ ID NO: 401236 - DNA, 553 bp, Homo sapiens
  misc_feature: GZ8MTXP02JTAEP.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaaagtggggtcccatcaaggttcagccggcagtggatctgggacagaattcagtctcaccatcagcagcctgcagcctgacgattttcgctaaacttactactgacccaagttgacaataaaataactactagttttacggggacgggaaggggacccgaaagggttacgggaagaacgtacctaaaaacgaaaccgtggtacggctaggccgtaaccagtcctagtcttaccagtttcccc

SEQ ID NO: 401237 - DNA, 663 bp, Homo sapiens
  misc_feature: GZ8MTXP02HF1UM.15.28.C06.1.454.CMB.2.raw
  modified_base (277)..(277): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgaccagtcctccgtccacctgtctgcatctggtcggagacagatcacatcactggccggcagtcagagtattataagtggttggctggttcagcagaacgaggaacaccaaaagtcngatctctgcccgtcctctactttcgacgtaaaacggtcggggtaccaagtacgtaaggttccgaaggccgggaccgtaaggtggacttcggttaggggaactagtaacgtttcaacggttcctacaccctataccaacgcacgtcccacgacgacgtcgtacgtacggttacttacgtacttaacttaaccttacgtacgtaccgtaacgtacgtactaaactaaattaaactaacgttacggtttaacggggtaccggggtaacgggggtaacccggaaaacgggttagggaacggtaacgttaaacgaaaaccggtaaaccgtaggtacggttacgtacgaacgtaaccgtacgtacgttcgttcctttactacgtttaccccg

SEQ ID NO: 401238 - DNA, 567 bp, Homo sapiens
  misc_feature: GZ8MTXP02FX1TO.15.28.C06.1.454.CMB.2.raw
  modified_base (553)..(553): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggttgctggttcagcagaaaccagggaaacgaccccaaaagtcctagatctctcgccgcctctacgtttgacgaaaaggtcggggtaccccaatccgaaaggtttccaaggccccggactaggtggaacttcgtaggggaacaggtaacttaccagttcctacaacactcagcaagccctagcaagtcccagtaccgtattttcgaccttaacttacactcgaccaagtcacaataataatctagtttcggacgggtaacggacgaaggtacggagataacaaacgtacgtagtcggctagccactactcgtntactcactttcccg

SEQ ID NO: 401239 - DNA, 580 bp, Homo sapiens
  misc_feature: GZ8MTXP02JNK5A.15.28.C06.1.454.CMB.2.raw
  modified_base (374)..(374): a, c, t, g, unknown or other
  modified_base (488)..(488): a, c, t, g, unknown or other
  modified_base (499)..(499): a, c, t, g, unknown or other
  modified_base (502)..(502): a, c, t, g, unknown or other
  modified_base (519)..(519): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggaggcctcgtccgaggccggggggtcctgagactctcctgtgacgctcgtggattcaccttgagctacttatggatgacgttggcccgcgaggcctccggaaggggaacggggtctgggaggtggggtcgacccaacaagtaaacgaaaaagngtaggaagtagaacaacaaacctagtagtcgacttctggtgagtcgggacctattcccgaccgtcctcctcgacgccctaccgaaccgacggccctacgtccgttcctcccccnggccctcctcnccncgagcgcctaccgacgnacgcacgcgcccgcgtggctcgcgtcgtacacgcttacgcgctacgactgcgacggcgtcg

SEQ ID NO: 401240 - DNA, 613 bp, Homo sapiens
  misc_feature: GZ8MTXP02J1A24.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccgggccagtcagagtattactaatggtgctgttcagcagaacaggaaacgacccaaaagtccagatctctcgcccgtcctacttactttgactaaaacgggtcggggtacccagtaccgtaaggttcaaggtcccggacgtaggtaggactcgtaggggaacaggtaattcgaacgtctacacatcacgccagcctggacctagccgtagtacgttatttacgactaacttactactcgacctagtcactaattaaataacgttcgtaacggtttcgggacggggtaacggtaaaccgtaaggggtacggaagtaacgtaaaccgaaaacgtacgttacggacggtacgtacggaacctacccgtagtccgttacgttcttacctactttccccg

SEQ ID NO: 401241 - DNA, 585 bp, Homo sapiens
  misc_feature: GZ8MTXP02G48B2.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtattactaatggtgctgttcagcagaacgaggaacaccccaaagtcctagatctctcgccgcctctacttgactaaggtcgggtccagtacgtaaggtcagccggacagtgatcgtggacagtatcagtcacacatcagcacggcctgcacgtctagacgttatttgacttaacttactactacgaccgtaagtgaccttaaattaaactactacgttaaggtttccggggaacgggtaacgggtaaccggtaaggggtacgaacgggaacttaaacgaaaccggtagtacgggtacgtacgttacgaaccgtaacctagttacgtaccggtttaccttaccgacctttcccc

SEQ ID NO: 401242 - DNA, 616 bp, Homo sapiens
  misc_feature: GZ8MTXP02FGODL.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccggcagtcagagtatactaatggtgctgttcagcagaacgaggaacaccccaaagtcctagatctctcgccgccttctactttgactaaaggtcggggtcccatcgaaggttcaggccgcgagtggatcgtaggacagaactcagtcctacacatcagcacgcctgcacgcctagtacgttagtttcgacctaaaccgtttactacgtgtaccctaagtcgtaactaaattaaacttaaacttccgttaagggtttaccggggaacgggtaaacggggtaaccgtaaaaggggttacgggaaacgtaacgtaaaccgtaaaaccggttacgtagggtacggtaccgtacgaacccgtaacttaacgttcgtacgtttacttacctacgtttccccgg

SEQ ID NO: 401243 - DNA, 710 bp, Homo sapiens
  misc_feature: GZ8MTXP02F21JL.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctgtcggagacagagtcaccatcacttcggccggccagtcagtagttaattaacttaaagtggttcggtccttggtttacagacaaacggaaaccgaagggaaaccgaccccgaaaagtcctagtactctctcgcccgtccttcttacgttgacgtaaagggtcgggtacccatcgaagttcgagccggcagtgatcgtacgggacagtaattcgacgtcctaccgactactcagacgacgtccctaggacaacgtccgtagttaaacgttacgtttttacgaaccttaaacgtttaacctaaccgtccgtaaacccggtaagttacgtaaacgtaaatttaaaacttaaacgttcggttaacggtttacccgggggaaccgggtaaacggggtaaccggtaaaaggggttaggaaaacgttaactaaaacggtaaaaaccggtcgttagggtaccggtacgtacggtaaccctaaaccgtcttacccgttacgttacctttacctaccggtttacccccg

SEQ ID NO: 401244 - DNA, 718 bp, Homo sapiens
  misc_feature: GZ8MTXP02IHBJQ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtcctgcatctggtcggagacagacgtcaccatctacgttcggccgggaccagtcagtagtattactaagtggttgcctggttcagcagaacgaggaacgacccaaaagtcctgatctctcgcccgccttctactttcgacgtaaacggtcggggtacccagtaccgtaaggttcgaacggtcccggtacgaggttgacgttacgacggggtaacaggtaacttcggaacgttcctaaccacccgtaatacccgacgtaccgacggtaccccgtacgtacgacgtaccgttacgttaacgttacgtttacgttaaccttaaccgttaaccgttaaccgtaccgtaccgtaacgttacgtacgtaaacttaaacgttaacgttacgttacggttaccggggtaaccggggtaacgggtaaacgggtaagggtaacggtaacggtaaacgtaaacgtaaaacggtaacggtacggtacggtacgtacgtaaccgtaacgtacgttacgttacgtttactttaccgttaccgttacccg

SEQ ID NO: 401245 - DNA, 606 bp, Homo sapiens
  misc_feature: GZ8MTXP02JPAJ1.15.28.C06.1.454.CMB.2.raw
  modified_base (289)..(289): a, c, t, g, unknown or other
  modified_base (333)..(333): a, c, t, g, unknown or other
  modified_base (356)..(356): a, c, t, g, unknown or other
  modified_base (440)..(440): a, c, t, g, unknown or other
tcagtctacgtagccacgaccggtgctcgatttagagctcacgtattgggtttgggggaagaggaagactgaaggcctttccacttggtgatcagcaactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccncgagctccgagggagggctggagtggtggccacataacaaaagntggaagtgacacaacctatgtanaacctctgtgagtgggccattcaccgtctaccgagacgacgacgccaaagactcactacatctagacaaatgaaacacgtgagngaccgaggacacggtctagtcgtattacgtggtgaggagagtagttcgttacgtggtacgggttcgggggaccctaacgggggtaaaccccctgggtaccccgtaacccgtttccgtccccttacgaacccggttccccaccccggaacccggtaaaccccggggg

SEQ ID NO: 401246 - DNA, 698 bp, Homo sapiens
  misc_feature: GZ8MTXP02JCWP5.15.28.C06.1.454.CMB.2.raw
  modified_base (310)..(310): a, c, t, g, unknown or other
tcagtctacgtagccacgaccggtgctcgatttagagctcacgtattgggtttggggggagtcagactcagtcaggacacagcatggacatgagggtcccccgctcagctcctggggctcctgctgctctggctcccaggtgaccaaatgtgacatccagatgacccagtcctccgtccaccctgtctgctatcgtgtcggagacagagtccaccatcacgttcggccgggcagtcagtagtattaactaagtggttcggcgttgttcagacgaagaaccgaggaaacgaccccaaagtcctagatctcncgccctcctcttacgttgacgtaagggtccgggtaccctagtacgtaacggtcgacggccggtacgtaggtgtacgtacggagggactaggtacttacgacgttccaccgactagtcaacgcgtacgccgtagcctaacggtcctaggtaccgttatttaccgaccttaacttaccgtacgtacgtaaccgtaaggtacctaactaaataaacttagtaccggttacgggttacggggacggggtaaacgggtaaccgggtaaagggttagggaaaaccgtaacggtaaaaccggtaaacccgggttaagttcgggtaaccgtaccgttaaccggaacctaaccgttaacgttcgtaccgtttcctttaacccgtacctttacccccg

SEQ ID NO: 401247 - DNA, 603 bp, Homo sapiens
  misc_feature: GZ8MTXP02JQHH8.15.28.C06.1.454.CMB.2.raw
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacgttgccgggcagtcagagtaattaactaaagtggttggcctggttcagcaagaaacagggaaacaccccaaaagtcctagatctctcgccgcctactactttcgactaaaggtcgggtacccatacgaaggttcacgtccggcaggtggaactcgtagggacagtaaacttcgaagtcctacaccaagtcaacgcagccctagacaagcctagacttatttacgactaacttacacttcgaaccaagtcgtactaaataaaataactcgtaacgtttcggacggggtaaacggacgtaaaggggtagaaacgagtaaaccaaaacggaaacgtgtacggacgttacgaactaaccgacttcgtacgtacctttacgactttaccccg

SEQ ID NO: 401248 - DNA, 539 bp, Homo sapiens
  misc_feature: GZ8MTXP02IA6TT.15.28.C06.1.454.CMB.2.raw
  modified_base (357)..(357): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagagtcaccatcacttgccgggcagtcagagtattactaaatggttggcctggttcagcagaacaggaaacgccccaaaagtcctgatctctgccgcctctactttgacaaagtcggggtcccatcaaggttcagccggcagtgatcgtaggacngattcagtctacacatcagcagcctgcacgcctagtactagttttcaccgaactttacctacttcgacccgtaagtcgactaataaataattctacgtttcggacgggtacggacgaagggtcggagataacaaacggtactggacgctacgaacgacactctacgttcttacactttcccg

SEQ ID NO: 401249 - DNA, 681 bp, Homo sapiens
  misc_feature: GZ8MTXP02IT0IY.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtcctccgtccaccctgtctgcatcgtgtcggagacagacgtcacatcacgttcggccggccagtcagattattaactaagtggttgccgttggttcagacaagaaccgaaggaaaccgaccctaaagtcctagactctctcgccctccttacttacttcgacgtaacggtcgggtccatacgtaaggtcgagccggacgtaggtcgagttcggtagggaactaggtacttacgtagtacctacaacctatacgacgcacgtacctcggacctacgtacgttacgaacgtttacgtttaccgaaccttaaacttaccttacgtacgtaacgtaaggtacaacttaattaaaacttagtacgttacgggttaccggggaagggtaaccgggtaacgtaaaggggtacgtaaacggtaaaccgttaaaccggaaaacggttacgtacggggtacggtaccgtagtaacccgtaactcgtttaccgttccgtttaccttaccgttacctttacccccg

SEQ ID NO: 401250 - DNA, 701 bp, Homo sapiens
  misc_feature: GZ8MTXP02JY0FQ.15.28.C06.1.454.CMB.2.raw
  modified_base (263)..(263): a, c, t, g, unknown or other
  modified_base (287)..(287): a, c, t, g, unknown or other
  modified_base (294)..(294): a, c, t, g, unknown or other
tcagtctacgtagccacgaccggtgctcgatttagagctcacgtattggggtttgggggagtcagactcagtcaggacacagaatggacatgagggtccccgctcagctcctggggctcctgctgctctggctcccaggtgaccaaatgtgacatccagatcgacccagtcctccgtcccaccctgtctgcatctggtcggagacagactcaccatcacgtcggccggcagtcagagtattactaagtggtcgtctgttcagnaagaacgaggaacacccaagtctnactctcncgcctctctacttcgacgtaaggtcggtaccatacgtagtcgacggcggcgtaggtgtacgtacggtaggggactagtacgttcgacgttaccaccacctagtaccgaacgccgtaaccggtccgtcggacctacggtcccgttagtaccgttaacgttttcgaaccttaacgtttaccgtaaccgtcgtaacccgtaaggtacctaaacttaacgttaaaattactttaccggggttaacgggttaccggggggtaaacggggaacgggggtaaacccggtaaagggggttaacggaacgggttaaaaccaacgggttaaaaacggttcccggtagggttacggacgttaacggaccctaacgtcggttacctcgttaccttaccttacccgttccgttacccccg

SEQ ID NO: 401251 - DNA, 618 bp, Homo sapiens
  misc_feature: GZ8MTXP02FQ7CJ.15.28.C06.1.454.CMB.2.raw
tcagtctacgtagccacgaccggtgctcgatttagagctcacgtattgggtttggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggccgtcgtccgaggccgggggggtccctgagactctcctgtgaagcctctggattcaccttgagcacttattggatgacgttggggtccgccgaggctccgaaggggaaggggctggggaggtggggtcggccaaccgataaacaaaaagagtggaaagtgaacacaacctatgagactctgtgagtcgggacgtattcgaccgtcctcagaacgacgaaccgccaaagaactaccactaacatcagacaaatgaaaccaacctagaacgacgcccggaaggacgacggacgttgagttaacttagtggttagtaggaacggagtacgtggttactcggggtacgggtttcgggggaccggtaccggggtaaccccggtcggttacccgtaaccccgg

SEQ ID NO: 401252 - DNA, 748 bp, Homo sapiens
  misc_feature: GZ8MTXP02FM9GT.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatcgtgtcggagacagacgtcaccatcacttggccggcagtcagagttattaactaagtggttggtcctggttcagcaacgaaaccgaaggaaacgaccccaaagtcctagactctcgtcgcccgtccttacttacgtttacgacgtaaacgggtccggggtaccctagtacgtaaacgggttacgaacggcccggggtacgtagggttacggacgttaccggggtaggggaaccgtagggtaacgtttccgtaaacggttacccttaccaacctaaacgtcccgaaagtacccgaacggtaccccgtagaccgaaccggtacccgttacggttaaacgtttactttttacggaacctttaaacctttaaaccgttaccgtacggtaaccgtaacggttactaacgaaatttaaaactaaacttacggttaacgtttacgggggaacggggtaacgggtaaaccggtaaaggggtaggtaaacgaacgttaaacaaaaacggtacgtacggttaggactacggaacctaactcgttaccgtcgttacttcctacgttcccg

SEQ ID NO: 401253 - DNA, 562 bp, Homo sapiens
  misc_feature: GZ8MTXP02F5UHP.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattaactaatggttggcctggttcagcaagaaaccagggaaacaccccaaaagtcctagatctctgcccgcctcttactttgactaaagtcggggtcccatacaggttcagccgcagtgatctaggggacagaattcagtctcaccatcagcacgcctgcagtcctagtacgtattttgactaacttactactgacctaagtcactaataaactatacgtacgtttacgggacggaacgggaaccgaagggtacgggaagtacgtaaacaaaaccggtaacgtggtacgggcttacgaacgacccgtatcgttacgtcttctactttccccg

SEQ ID NO: 401254 - DNA, 739 bp, Homo sapiens
  misc_feature: GZ8MTXP02I2H1G.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaagtggttggccttgttcagtacgaacgaaaccgaggaaaccaccccgaaaagtcctacgattcctacgtcgtcccgtccttacgttaccgtttcggacgtaaaacgggtcggggttacccctaacgtacgtaaacggttccgtaacggacccgggtacgtaggtcggtaagttcccggttacggggaacctacggtaagttaccgtacgttacccgtacccgtaacgtacgtacgaacgtacgaacccggtcccgtacgaccgtaacgtccccgtaaggtacgttacgttttaccgaaccgttaaccttaaacgttaccgtacgaacccctaagggtactactaaattaaacgttaccgttacgttacgtttacggggaaccggggtaaacgtaaccgttaggggaaccgtaaagaacgttaaaccgaaaccggtaagttcggttaacgcgttaaccgaactaaccgtcttacgtacggttacctacggttaccctttcccg

SEQ ID NO: 401255 - DNA, 683 bp, Homo sapiens
  misc_feature: GZ8MTXP02IYGO3.15.28.C06.1.454.CMB.2.raw
  modified_base (199)..(199): a, c, t, g, unknown or other
  modified_base (663)..(663): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagacgtcaccatcacttcgccgggccagtcagagtattaactaagtggttcggcttggttacagcaacgaaaccgagggaaacgaccccgaaaagtcctagactctcgtcgcccgtccctcttactttagaccgtaaaagggtcgggtaccctacgtaccgtaaggttccgacggtccccggacgtacggtggtaacgtcggtacgggactaggtaacttcgacgtcctaccacacgtcacgcgtaacgccctaggacacgtacctcggtagtttactttacgaccttaaaccgttacgttaccgtccgtaacccgtaagggttacgaacctaaaagttaacttaagttaccgttagggtttaaccggggacgggtaaaccgggacgtaagggtagggaaaactacgtaaaccgtaaaacgaagttcggggtacgagtaccgaactaacgtacttaccggtntttacgtcctactttccccg

SEQ ID NO: 401256 - DNA, 578 bp, Homo sapiens
  misc_feature: GZ8MTXP02GRG03.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtcctgcatctgtcggagacagagtcaccatcacttgccgggcagtcagagtattactaaatggttgcctggttcagcaagaaaccaggaaacaccccaaaagtcctagatctctgccgtcctactactttgacaaagtcgggtcccatcaaggtcaggccgacagtgatcgtaggacagaattcagtctcacatcagcacgctgcagcctgacgtatttgaccaactttaccactacgacctaaggtcacctaaataaactactaccgtagtttaccggacgggaaacgggtaccgaaagggttacgggaagtaactaacgaaaaacgtaacggttgtaacggggccttaggcctaaaacccgttacgtcgttacgtaccgttacgtacttacccg

SEQ ID NO: 401257 - DNA, 602 bp, Homo sapiens
  misc_feature: GZ8MTXP02GXNR6.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccggccagtcagagtatactaagtggttgctgttcagcagaaccaggaaacgaccccaaaagtcctagatctctcgccgctctacttgactaacggtcgggtccatacgtaagtcgagccggacgaggtgtactcgagggacagtaattcactcgtacctacatacagctagcctagcgacgtacccgtagtacttagttttcgaacctaactttacctacgtcgtaccgaacgttacgacctaaataaaagttaacgttacgtaacgtttacgggaccgggtaacgggaaccgtaaggggttacgaagtacgtacgaaaaccgtagtacgttcgacgtacgtaacgtacctacgttactacgtaccttcgtaacgtttccccg

SEQ ID NO: 401258 - DNA, 631 bp, Homo sapiens
  misc_feature: GZ8MTXP02HSJ64.15.28.C06.1.454.CMB.2.raw
  modified_base (418)..(418): a, c, t, g, unknown or other
tcagtctacgtagccacgaccggtgctcgatttagagctcacgtattgggtttggggggagtcagactcagtcaggacacagaatggacatgagggtccccgctcagctcctggggctcctgctgctctggctcccaggtgccaaatgtgacatccagatcgacccagtcctccgtcccacctgtctgcatctgtcggagacagagtcaccatcacttcgccgggcagtcagagtattactaagtggtgctggttcagcaagaaacaggaaacaccccaaaagtcctagatctctcgcccgtcctactactttgacgtaaggtcggggtacccagtacgtaaggttcaggtccggacgtaggtcggtactcgtaggggacagtatttcacgtctaccacactcaacgctacgcccgtnacgacgccgttacgacgtttacgtttacgacctaaactttacgtactacgtaacctaagttacgacttaaagttaactaacttacgttacggtttacgggaacggggtaacggaaccggtaaagggtcggaaaagtacgtaaacgaaacgtacgttacggtacgacgtcgacctaaccgtatcgttacgtccttaacgtctttcccgtacccg

SEQ ID NO: 401259 - DNA, 606 bp, Homo sapiens
  misc_feature: GZ8MTXP02JPXQL.15.28.C06.1.454.CMB.2.raw
  modified_base (199)..(199): a, c, t, g, unknown or other
  modified_base (211)..(211): a, c, t, g, unknown or other
  modified_base (292)..(292): a, c, t, g, unknown or other
  modified_base (403)..(403): a, c, t, g, unknown or other
  modified_base (418)..(418): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgaccagtcctccgtccaccctgtctgcatctgtcgganacagagtcaccntcacgttcgccggcagtcagtagtattactaagtggtcgctgttcagcaagaacgaggaacaccctaaagcctgactctcncgcctctacctacttcgacgtaacggtccgggacctagtacgtaggttcgacggccggactaggttcgactacggtagggaactagtatacgtagtacctaccgacgtacncgacgtacacgtccngtacccgaagtcccgtagtaacgtttactttacgaaacccttaactttaccacgtccgtaaccgtacgtacactaaattaaccgtaattacggtacggttacggacgggtagaacgttaggagtagtaacaacgtaaagtcgtagtacgcgtacaaccgtacgtactcgtacttctacgtacctcccg

SEQ ID NO: 401260 - DNA, 741 bp, Homo sapiens
  misc_feature: GZ8MTXP02F0KQF.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccgggcagtcagagtattactaatggttgctgttcagcagaaacgaggaacacccaaagtcctagactctctcgcctcctcttactttgacgtaaaaggtcggggtacccagtacgtaacggttcgaggcccggacgtaggtacgggacttcgtaggggaactacgtaaacttcgtacgttacctaccaaccgtataccgaaacgccgtaacgtcccgtaggccgtaacgtcccgtagtaaccgtttaagtttttacggaaaccttaaaccttttaaccgtaaccgttacggaaaccccgttaaagggttacgtaaaccgtaaaagtttaaaactttaaaccgttacggtttaacggggtttaaccgggggaaccgggggtaaaaccggggtaaccggtaaaagggggttaacgggaaaacgtaaacgttaaaaccggaaaaaccggttaacggttcggggtacgtaacgttcgaaccgtaacctacgtttccgttaccgtttcctttacctactttccccg

SEQ ID NO: 401261 - DNA, 642 bp, Homo sapiens
  misc_feature: GZ8MTXP02GIQA4.15.28.C06.1.454.CMB.2.raw
  modified_base (256)..(256): a, c, t, g, unknown or other
  modified_base (284)..(284): a, c, t, g, unknown or other
  modified_base (286)..(286): a, c, t, g, unknown or other
  modified_base (291)..(291): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccacctgtctgcatctgcggagacagacgtcaccatcacttcggccggccagtcagtagtattactaagtggtgctgtcancagaacgaggaacaccgaagtctgatcncncgccnctcttactcgacgtaacgtcgggtaccagtacgtaggtcgaggccgcgaggtaggctacggtcggacagtaacttcgacgttcctacgactagactacgacgacgtccctcgacgacgtcccgtagtaaccgtttacgttttacgaaccttaacttaccgtaaccgtcgtaccgtaaagtctaaaccttaaattaacttaacgtacgtttaacgggttacggggaacggggtaaaccggtaacgggtaaggggtagggtaaaccgagttaaaccggaaaacggacgttcgggtacggccttacgaaccgttactactttaccggttctttacccttctacccgtttccccg

SEQ ID NO: 401262 - DNA, 575 bp, Homo sapiens
  misc_feature: GZ8MTXP02J040Y.15.28.C06.1.454.CMB.2.raw
  modified_base (353)..(353): a, c, t, g, unknown or other
  modified_base (386)..(386): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctagatctctgccgcctctactttgcaaaggtgggtcccatcgaagtcagcgcagtggatgtggacngaattcagtctcactatcagcagcctgcagccnggacctatttcgactacttactactcgaccaagtgactaaataataactacgtaacgtttcggggacggtaacggggaaccgtaaggggttccggaaagttacgaaccgaaaacgtaacctggttaacgggcttacggaacgttacccgaacgttccgttacgttcctttaccggtaacgtttcccccg

SEQ ID NO: 401263 - DNA, 606 bp, Homo sapiens
  misc_feature: GZ8MTXP02IH9AB.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagagtcaccatcacttggccggccagtcagagtattaactaagtggttggccttggttacagacgaagaaaccgaagggaaacgaccccaaaagtcctagtactcctctcgcccgtcctacttactttggactaaagggtcggggtacccatacgaaggttcgaggccggacgaggtggactcgtgggaacagtaattcgacgtcctaccaccatcgagcacgcctgcacgcctagacgttatttcgacctaaacttaccgtacgtagaccgtaagtcgactaataaataacttacgtaaggttcgggacgggtacgggaaaccgtaaggggtacgaagtactaaacgaaaacggacgttggacgtcagaaccacgtactcttcgtacttaccgtactttccccg

SEQ ID NO: 401264 - DNA, 644 bp, Homo sapiens
  misc_feature: GZ8MTXP02GN8PQ.15.28.C06.1.454.CMB.2.raw
  modified_base (405)..(405): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttcgccggcagtcagagtatactaatggtgctgttcagcagaacgaggaacaccccaaagtcctagatctctcgccgcctctacgtttgacgtaaaggtcgggtaccatacgaaggttcagtccggcagtggatcgtgggaactaggtaacttcgaacgttctaccacacttacgacgacgacggtcccnggaccgacgtcccgtaggtaaccgttagtttttacggaccttaaaccgtttacctaaccgttacgtacccgtaaagggtcgaaacctaattaaaacttacttacgttacggtttaccggggacgggtaacggggaaccgtaaggggttaggaacgtaacgtaacgtaaaaccggtacgttggacggtacgtacggaaccgtaccgtaattcggtacgttacttaccgtaactttccccg

SEQ ID NO: 401265 - DNA, 626 bp, Homo sapiens
  misc_feature: GZ8MTXP02H4F7L.15.28.C06.1.454.CMB.2.raw
  modified_base (196)..(196): a, c, t, g, unknown or other
  modified_base (404)..(404): a, c, t, g, unknown or other
  modified_base (575)..(575): a, c, t, g, unknown or other
tcagtctacgtagccacgaccggtgctcgatttagagctcacgtattgggtttgggggagtcagactcagtcaggacaaagcatggacatgagggtccccgctcagctcctggggctcctgctgctctggctcccaggtgccaaatgtgacatccagatgacccagtctccgtccacctgtctgcatctgtcgganacagagtcacatcacttgccggcagcagagtattactaagtggttgctggttcagcaagaaacagggaaacacccaaaagtcctagaactctctacgtcccgaccttcgttactttgacgtaaaaggttcggggtacccaagtacgtaaggttccaggcgaccgaggtgaactcgagggaacagtacttcgacgtcctacgaacctanacacgacgacgccctggacaacgtcccgtaggtacgttacgttttacgaaccgttaactttaacgacttacggacctaaggtacgaactaaagtaaactaagtaccgtacggtttacggacgggaacggtaaccgaaaggttagaaggtactaaccgaaaagtacgtcggngtaaccgtcgaacaaccgttctacgttctacctaactcgtttaccctcccg

SEQ ID NO: 401266 - DNA, 550 bp, Homo sapiens
  misc_feature: GZ8MTXP02FKE97.15.28.C06.1.454.CMB.2.raw
  modified_base (358)..(358): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaaagtcctagatctctgaccgcctctactttgcaaaagtggggtccatcaaggttcagcggcagtggatctgggacngaaattcagtctacacgatcagcacgctgcagcctgacgatttgacaacttacaactgaccaagtgcaataaataaatcaatttcgggacggtacgggaccgtaaaagggtcgggaaagtaggttaccaaaacggaaaccgttagtcggggacttcggcgaacccaattcctggtactttccaagttccccg

SEQ ID NO: 401267 - DNA, 679 bp, Homo sapiens
  misc_feature: GZ8MTXP02HO1DX.15.28.C06.1.454.CMB.2.raw
  modified_base (199)..(199): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagatcaccatcacttcggccggcagtcagagttatactaagtggtggctgttcagcagaacaggaacacccaaagtctagatctcgtcgccgtctcttacttcgacgtaaaggtcgggtacctagtacgtaaggttcgaggtccggacgtaggtcggtattcggtagggacagttaaagttctagtcccttacaactactcagacacgtcctacggacacgtaccgtagtacgtttacttttacgaccttaaactttaccgtaacgtcgtaaccgtaagttacgaacttaaacttaaaattaacgttaccgttaaacggtttccgggggaacgggggttaaaccgggacgggtaaaacgggttaaggggaaacggtaaacggtaaaccggtaaaaacggttaccgttagggtacggtaccttacggaaccgtaactacgtttaccgttcgttaccctttacgttaccgtttacccccg

SEQ ID NO: 401268 - DNA, 552 bp, Homo sapiens
  misc_feature: GZ8MTXP02FFW39.15.28.C06.1.454.CMB.2.raw
  modified_base (351)..(351): a, c, t, g, unknown or other
  modified_base (353)..(353): a, c, t, g, unknown or other
  modified_base (357)..(357): a, c, t, g, unknown or other
  modified_base (362)..(362): a, c, t, g, unknown or other
  modified_base (389)..(389): a, c, t, g, unknown or other
  modified_base (393)..(393): a, c, t, g, unknown or other
  modified_base (489)..(489): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccgggccagtcagagtattactaagtggttggcctggttcagacagaaaccgaagggaaacgaccccaaaagtcctagatctctcgcccgtcctctactttgacaaaggtcgggccatcaggttcagccgcagngntcgnggacngatcagtctcacatcaagcaggtcccngacncgcgtagtacgttagtttacgactaactacgtacacgacgtagactaactaataacgtactacgtaggtcggacgggacggtacgaaggtacgaanacgtaaacgaaacgtacgtgacgacgtacgaacctactacgtcttacgtactacctactcccg

SEQ ID NO: 401269 - DNA, 662 bp, Homo sapiens
  misc_feature: GZ8MTXP02H39JD.15.28.C06.1.454.CMB.2.raw
  modified_base (198)..(198): a, c, t, g, unknown or other
tcagtctacgtagccacgaccggtgctcgatttagagctcacgtattgggtttgggggagtcagactcagtcaggacacagcatggacatgagggtcctcgctcagctcctggggctcctgctgctctggctcccaggtgccaaatgtgacatccagatgacccagtcctccgtccaccctgtctgcatctgtcgganacagagtcaccatcacgttgccgggcagtcagtagttaattactaaagtggttcggtccttggttcaagtaacgaaaccgaagggaaaacaccccaaaaggtcctagactcctctcgcccgtccttcttactttgacgtaaaacgggtcggggtacccacgtaccgtaaagggtcaaggccccggtacgtacgggttaggacgttcgtaggggacctaggtaactttcgaacgttcctaccaacctatccgaaagcccaaggtccctgaccacgtccgtaggtacgttacgttttacgaaccttaaactttaacctaccgttacgacgtaacgttgactaaaattaaacttataccttaggttacggagggtacggaaccgtagggtacgagtaaacacgaaaacggactcgggtacgactacgaaccgtactacttcgttcgttaccttacgtactttccccg

SEQ ID NO: 401270 - DNA, 687 bp, Homo sapiens
  misc_feature: GZ8MTXP02IXF0Z.15.28.C06.1.454.CMB.2.raw
  modified_base (255)..(255): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtctccgtccaccctgtctgcatcgtgtcggagacagagtcaccatcacgttgccggcagtcagtatattactaagtggttgcctggttnagacaagaaccaaggaacgacccaaacgtctacgatcactcgaccgtcctcttacttcgacgtaaagggtcgggtaccagtcaaaggttcacggcggtacaggtacgtacgtcgtaggggactaggtactttacacggttactaccaaacccgttagaccgacgtcgaccgtccgtacgaccgacgtacccgtaggttaacgtttacgttaaccgtaaccttaaaccgtttaccgttaaccgttaaccgaacgttaagtaacttaactaaaacgttaacttaacgttacggttaacggggttaccgggaaacggggtacgggtaaacggtaaggggtaacgtaacgtaaacgtaaaccggtaaaacggtacgtacggtacgtacgacgtaaccgtaactacgttccggttactaccttcgttacccgttccg

SEQ ID NO: 401271 - DNA, 604 bp, Homo sapiens
  misc_feature: GZ8MTXP02H6XXS.15.28.C06.1.454.CMB.2.raw
  modified_base (262)..(262): a, c, t, g, unknown or other
  modified_base (298)..(298): a, c, t, g, unknown or other
  modified_base (343)..(343): a, c, t, g, unknown or other
  modified_base (359)..(359): a, c, t, g, unknown or other
  modified_base (384)..(384): a, c, t, g, unknown or other
tcagtctacgtagccacgaccggtgctcgatttagagctcacgtattgggtttggggggagtcagactcagtcaggacacagcatggacatgagggtcccccgctcagctcctggggctcctgctgctctggctcccaggtgccaaatgtgacatccagatcgacccagtcctcccgtcccacctgtctgcatctggtcggagacagagtcaccatcactcggccggaccagtcagtagtattaactaagtggtgctgtcanacagaacgaggaacaccaaagtctgatctctcgccnctctactttgacgaaggtcgggtaccatacgtaaggtcagccggnaggtgatcgacggganagtaattcagtctacactatcacgnacgcctgacacgacctaggtaacgttatttcgacctaaacttacgtactcgaacctaagtacgaactaaattaataaacgttaccgttaaggttaccggggacggggtaacgggaaaccggtaagggggtaacggaaagtaaacgttaaacgaaaaacggaccgttagggacgtcgtacgaacctaacgtactactttcgtaccttacgtacttaccccg

SEQ ID NO: 401272 - DNA, 726 bp, Homo sapiens
  misc_feature: GZ8MTXP02HOGKQ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctactgctgctctggctcccaggtgccaaatgtgacatccagatgacccagtcctcccgtcccaccctgtctgcatctggtcggagacaggatcacatcacgttcggccggccagtacagtagttaattaacgtaaagtggttcggccttggttcagacaaacggaaaccgaaggaaaccgaccccgaaaagtcctagtatccgtctcgcccgtcccttctttacgttcggaacgtaaacgggttccggggtaccctaagtaccgtaaacggtcgaacggtccccgggactaagggtcgggtaactccggtaggggaactaggtaactttaccgtacgttacctaccaaacctagccacggtaccacgtccgtaggacctacggtccgtacgggtactttacgtttcgaaaccttaacgtttacctacgttcgtaacgtaagtcgaacttaaaataacgtaaacgtcgttaaacgggtaccggggacggtaacggggtaaaccgaggggttaacgaaacggtactaaaacccggaaagtacgtcgggtaccgtaccgtaccgaacctaaacggtaccgttctaccgttcccgtttacaccctttccccgg

SEQ ID NO: 401273 - DNA, 617 bp, Homo sapiens
  misc_feature: GZ8MTXP02IETZF.15.28.C06.1.454.CMB.2.raw
  modified_base (197)..(197): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctccaggtgccaaatgtgacatccagatgacccagtctccgtccacctgtctgcatctggtcgganacagtagtcacatcacttcggccgggcagtcagagttataactaagtggttgccttggttcagacaagaaaccgaggaaacaccccaaaagtccagatctctcgccgtcctactacgtttgactaaagggtcgggtaccatacgaagttcgagccggacaggtgagttcgacgggaatagtaaacttcacgttacctaccaaccggactacggaccgacgacgcgtcgacgtacgtacgtacgtacgttaacgttacgtactaacttaaccttacgtacgtacgtaagtacgtactaataaagttaactacgttacgtacggtacggtacgggaacggtaacggtacggaagaacgtaacgtaaacgaacgtacgtacgtacgtacgaacgtactacgtactacgttacttactactccg

SEQ ID NO: 401274 - DNA, 631 bp, Homo sapiens
  misc_feature: GZ8MTXP02IPIUG.15.28.C06.1.454.CMB.2.raw
  modified_base (197)..(197): a, c, t, g, unknown or other
  modified_base (290)..(290): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcgganacgagagtcaaccatcacttgccggcagtcagagtattacgtaaagtggtgctgttcagacagaacgaggaacacccaaagtcctgaatctcncgccgtcctctactttgacgaaaaggtcgggtaccaagtacgtaaggttacacggcccggacgaggtaggtacgtacggtagggtaacagtaacgttacaaccggttcctaccaacctaagtaccgacgtaccacgcccgtagacctacgcccgtagtaaccgttatttacgacgtaaactttactacgtcgacctaagtcgactaaataaacgtactacgtacgtttacggggacgtaacgggtaccgaaaggttcggaaagaccttaaacgaaaacgtaacggttcgacggtcctggaaccctacgtagttaccgtacgttaccttacgactttccccg

SEQ ID NO: 401275 - DNA, 640 bp, Homo sapiens
  misc_feature: GZ8MTXP02FRLNL.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccgggcagtcagagtatactaatggtgctggttcagcagaaaccaggaaacgaccccaaaagtcctgactactctcgcccgtcctctactttgactaaacgggtcgggtaccagttaccgaaagggttcaggtcccggacagggtcggaacttcgtacggggaactaggtaaccttcgtaacggtaccttacaaccctagttccgaacgtaccaacggtccccgttagcccgaagtccccgtagtaccgttaattttcgaactacgtttactaacgtcgtacaaaggttcaactactaaagttaacgtctaacggtttcggggacggaacggggtaaccaagggtaggaacgtacgtaacgtaaaacgacgtttgacggtacctaggaaccgactacgtccgttagtccttactacgtttacccg

SEQ ID NO: 401276 - DNA, 759 bp, Homo sapiens
  misc_feature: GZ8MTXP02F8TW7.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagtagttattactaagtggttggcctggttcagcagaaacagggaacaccccgaaaagtcctgatctctacgccgccttactacttttcgacgtaaaagtcggggtaccccaagtccgtaaaggttccaacggcccggaccgtagggtacggtaacgtcggttacggggaacctaggggtaaaactttccgggaacgtttaccgtacccgaaaacctaacgttaccaaacgtcccgtaaaccggacccttcggggacctttaaacgccccggtaggtaaaaccggtttctttttaccgaaccttaaaaccgttttaaccggttaaacccgtacggtaaaccgtaagtacgtaaacttaaacttaaaacgttacggttaccgttacggtttaacgggaccggggtaaacgggtaaccggtaaagggtacggaactaaacggtaaaccggtaaaacggtacggttacggtacggtacctaacggaaccgttaaccgttattacccgtactttacctaccggtaccgtttacccg

SEQ ID NO: 401277 - DNA, 720 bp, Homo sapiens
  misc_feature: GZ8MTXP02GYUTF.15.28.C06.1.454.CMB.2.raw
  modified_base (199)..(199): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcgganacagactccaacatcacttggccggcagtacagtagtattacaaagtggtggtctggttcaggacaagaaccgaaggaaacacccgaaaagtccagatctctcgccgtctacttactttcgacaaaggttcgggtaccctagtacctaaagggttcaacggtccccggagtagttagggaacgttcggtaggggaacacggttaaattcgtaacggtaccttaccgaacccaaagttcccaaagccaaccggtttccacggactacgcgtacggtaccgttaaggtttacgtaccgtaaccttaacttacttacggaccctaacggtacgtaacgtaaataaacgttaaataacgtaacgtttacgggtaccgggtaacgggtaaaccggtaaacgggtaacgggtaacggtaaagtaaacggaaaacccggtaaacggttaacgttcggggtaacccgtaccgtaaccgtaaccgttaccgttaccgttaccgtttaccgttaccgttaaccgttacccg

SEQ ID NO: 401278 - DNA, 583 bp, Homo sapiens
  misc_feature: GZ8MTXP02GBS0N.15.28.C06.1.454.CMB.2.raw
  modified_base (198)..(198): a, c, t, g, unknown or other
  modified_base (270)..(270): a, c, t, g, unknown or other
  modified_base (285)..(285): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagactcaccatcactggccggccagtcagtatattactaagtggttgctggttcagcagaacgaggaacncccaaagtctagatnctcgccgcctctacttcgacgtaacgggtcggtcctagtacgtaagttcgaggccgacgaggtagactgtagggacagtacttcgaagtctaccactagtcaacgcacgcctgaccgtacgcctagtacgtttagtttccgaacttaaacctttactaacctccggacctaaaggtcctacaaattaaatacttacgtagggtttccggagggtaacgggtacgaggggttacgacggaataacgaaaggtactgcggactacgaactacgactttcgacgtttcttacgacttcccg

SEQ ID NO: 401279 - DNA, 614 bp, Homo sapiens
  misc_feature: GZ8MTXP02FIA5M.15.28.C06.1.454.CMB.2.raw
  modified_base (200)..(200): a, c, t, g, unknown or other
tcagtctacgtagccacgaccggtgctcgatttagagctcacgtattgggtttgggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagagtcaccatcacttggccgggccagtcagagttattaactaaagtggttggcctggttcagcagaaaccgagggaacaccccgaaagtcctgatctctcgccgtcctactactttcgacgaaaggtcggggtacccagtacgaaggttcaggcccggacgagtaggatcggtaggggaactagaacttcagtctaccaacatcaacgcacgcctgccagtccctaggtaacttcgtttacacctaaacctttacctacgtacgacccgaaaggtcaactaaactaaacttaatacttagttccggggacggggtaacggaacgaaaggggtcgaacgagtaaccaaaacggtaacgtcggtacggtcgacgaacctaccctattccttgttaccttaccactttcccccg

SEQ ID NO: 401280 - DNA, 674 bp, Homo sapiens
  misc_feature: GZ8MTXP02GEJ93.15.28.C06.1.454.CMB.2.raw
  modified_base (199)..(199): a, c, t, g, unknown or other
  modified_base (444)..(444): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagactcaccatcacttggccggcagtcagagttaattaactaagtggttcgcttggttcagacaagaaaccgaaggaaacaccccaaagtccagactctctcgcccgtcttactactttgaaccgtaaaacgggttcggggtaccctagtacgtaacggttcaacggcccggtactaggtggaagttcggaggaacaggtaattcgaacgttacctaccgaacacgtacacgaccaacgcccncgacgtacgtacgtacgtaacgttagtttaccgaaacttaacctttacctaacgacgtaacgtagtacaaacttaaactaaactacttacggttacggttacggggaacgggtaaacggtaaacggttaagggtacgaaaagtaaacgtaaaccggtaaaacgtaacgtcggtacgtacgtacaaccgtacgttacgttacttacttacccttacgttacccgtttcccg

SEQ ID NO: 401281 - DNA, 709 bp, Homo sapiens
  misc_feature: GZ8MTXP02F0DCT.15.28.C06.1.454.CMB.2.raw
  modified_base (684)..(684): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatcgtggtcggaagacagagtaccaccatcacgttcggcccgggaccagtcaagtagttattaacgttaagtggttcggcttggttcagacaaggaaaccgaaggaaaccgacccctaaaagtcctagacttcctctcgcccgtccttacttacgtttcgaacgtaagggtccggtacctagtcgtaaggttcgacggccgacgtagtacggtacgtcggtaaggactacgtaaacttaccgtacgttaccctaaccgtacctaacgtacacgaccgtacgtacccgtagccgtaacgtccgtacgggtaactttacgtttacaacgttaactttaaccggtactacggtaccgagttacgaaccttaaataaacttacgttacgtaacggtttacggggaacggaaccggggtaaacgtaggggtaacgaagtaaccgtaaacgtaaaaccgtaggtacggtacgggacttacgaacccgtacgtaacgttcgngtttaccctacgtacttacccccgg

SEQ ID NO: 401282 - DNA, 596 bp, Homo sapiens
  misc_feature: GZ8MTXP02IYEIT.15.28.C06.1.454.CMB.2.raw
  modified_base (440)..(440): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccagggtgccaaatgtgacatccagatgacccagtcctccgtccaccctgtctgcatctggtcggagacagagtcaccatcacttgccgggcagtcagagtattaactaagtggttggtcctggtttcagacaagaaaccgaagggaaaacgaccccaaaaggtccctaggactctacgtcgccgcctctactttgacgtaaaacggtcggggtaccatacgtaaaggttcgacggccggtcagtggactgtaggggacagtaatcaagtctacacatacagcagacctgccagccagtaacgtnttttacgactaactttacctacgtcaccgtaagtcataaataaataatactaacggttcggacgggtaacggtaaccgaggtaggtaacgactaaacgaaaacgtaaacgtgacgtcgtacaacgactaacttccgagttcctacgtactttcccg

SEQ ID NO: 401283 - DNA, 631 bp, Homo sapiens
  misc_feature: GZ8MTXP02GVNYG.15.28.C06.1.454.CMB.2.raw
  modified_base (199)..(199): a, c, t, g, unknown or other
  modified_base (270)..(270): a, c, t, g, unknown or other
  modified_base (359)..(359): a, c, t, g, unknown or other
  modified_base (385)..(385): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcgganacagagtccaccatcacttcggccggcagtcagtagtatacgtaatggtgctgttcagcagaacaggaacncccgaaaagtcagatctcgcgccgtctctacttgacgaaaggtcggtccatacgaagttcgacgccggcagtgatcgtaggacagtatnacgtcctacacgatcgacgacgtacnctcgacacgtcctagacgttagtttacgacttaaacgttactacgttcggaccgttaagtacggaacttaaataacgttaaacgttacgtacggttttacgggaaccggggtaacgggtaaaaccgtaggggttaaacgacggtaaactaaaccggtaaaaaccgtaccggtaggtaccggtacgttaaccggaaccgtaaacctacgttcggttaaccgtacctttacgtaccgtttaacccccg

SEQ ID NO: 401284 - DNA, 573 bp, Homo sapiens
  misc_feature: GZ8MTXP02IELEJ.15.28.C06.1.454.CMB.2.raw
  modified_base (168)..(168): a, c, t, g, unknown or other
  modified_base (250)..(250): a, c, t, g, unknown or other
  modified_base (253)..(253): a, c, t, g, unknown or other
  modified_base (266)..(266): a, c, t, g, unknown or other
  modified_base (356)..(356): a, c, t, g, unknown or other
  modified_base (445)..(445): a, c, t, g, unknown or other
  modified_base (548)..(548): a, c, t, g, unknown or other
tcagtctacgtagccacgaccggtgctcgatttagagctcacgtattgggtttgggggagtcagactcagtcaggacacagaatggacatgagggtcccgctcagctcctggggctcctgctgctctggctcccaggtgccaaatgtgacatccagatgacccagtcnccgtccaccctgtctgcatctgtcggagacagagtcaccatcacttgccgggcagtcagagtatactaaatgttgctggttnagnagaaacaggaaanaccccaaaagtcctagactctctgcctcctactactttgacgtaaaggtcggggtacccatacgaaggttcacggtcggcctagtcggtncgtagggacagagttcagtctacaccgatcagcagccctgacacgctacggacttaatttcgctaaactctaacttggaccaaaagttnaataattaataagtacgttaggttacgggacgggtaacggaaccggtaagggtaggtaacgtagtaaccgaaaacgtagtacggtacgcgtacgcctaacgtntctcttccttactcgttaccctccg

SEQ ID NO: 401285 - DNA, 563 bp, Homo sapiens
  misc_feature: GZ8MTXP02GA9JJ.15.28.C06.1.454.CMB.2.raw
  modified_base (270)..(270): a, c, t, g, unknown or other
  modified_base (283)..(283): a, c, t, g, unknown or other
  modified_base (295)..(295): a, c, t, g, unknown or other
  modified_base (343)..(343): a, c, t, g, unknown or other
  modified_base (458)..(458): a, c, t, g, unknown or other
  modified_base (528)..(528): a, c, t, g, unknown or other
tcagtctacgtagccacgaccggtgctcgatttagagctcacgtattgggtttggggtgagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcacatcactgccggcagtcagagtattactaaatggttgcctggttcagcagaaacagggaaanccccaaaagtccngatctctcgccncctctactttgactaaaggtcggggtcccagtcaaaggttcacgcggngagtggatcgtgggcagattcgatcacaccatacgagtcacgctgcacgcctagtaacgttcgtttacgactaaactttaccgtactcggtacaagtcgataacttaaataactntaacggtttcggacggggtacgggaacgacgggtacggaggaaacgtacaaacgtacgtacgtcggtacncgtaacgacctactcgtacgttacttacgttaccg

SEQ ID NO: 401286 - DNA, 636 bp, Homo sapiens
  misc_feature: GZ8MTXP02FINSJ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgctatctggtcggagacagagtccaccatcacgttcggccgggccagtcaagagttaattaactaagtggttcgctggttcagacaacgaacgaggaaacaccccgaaagtcctgactctctcgccgtcctctactttggactaagggtcgggacctatacgaaggttcaggccgacgagtggatcgtagggacagtacttacagtctacaactatcagcacgcctgactgccgtagtacgttactttacgaccttaacttacgtaccgtacgtaacccgaagttacaactaaatttaaactaacgtacgttaacggggtttaccgggacggggaaacggggtaaaccgtaaggggtacgtaaagaaacttaacgggaaaacgtacgttaggtaccggtcgtaccgaactaccgtaagttccgtacgtttcctaccttccctttaccccg

SEQ ID NO: 401287 - DNA, 581 bp, Homo sapiens
  misc_feature: GZ8MTXP02I9JZY.15.28.C06.1.454.CMB.2.raw
  modified_base (252)..(252): a, c, t, g, unknown or other
  modified_base (266)..(266): a, c, t, g, unknown or other
  modified_base (432)..(432): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccggcagtcagagtattactaatggtgctggttnagcagaacaggaanacccaaagtcctgatctctcgccgctctacttgacgtaaaggtcgggtaccagtacaaggtcacgccggacaggtgactcgtaggaacaggaattacagtacctccaacagtacagacacgcctgacctagccctagacgttactttcgaccttaacttacttacncgtacctaagtactactaattaaaataactacttaagttacggggacgggtaaacgggtaccgaaagggtagggaataagtaaacgaaaacggtaacgtagtaacgtccgtacaaccgaacctattcctcttactacctacgtttcccc

SEQ ID NO: 401288 - DNA, 642 bp, Homo sapiens
  misc_feature: GZ8MTXP02I82UF.15.28.C06.1.454.CMB.2.raw
  modified_base (446)..(446): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagacgtccaccatcacttcggcccgggcagtcagtagtattaactaagtggttcggcttggttacagacaagaaaccgaggaaacaccccaaaagtcctagactctctcgcccgtcctccttacgtttcgaacgtaaacgggttccggggtacccctagtacgtaaacgggttcacggaccggaccgtaggtgtacgtcgtagggaactaggtacttcgacgtcctacctacatacacgactanccgtcgacacgtctagtacgtttagtttcacctaactttaacacgtacgacgtaatcgtataaataattacgtcgtaacggtttcgggacggtaagggaacgtaggtaacgagtaaactaacgaaaacggtacgtcggtaacgtcctacggaaccttacgtacgttacgttacgttccttaacgtctttacccccg

SEQ ID NO: 401289 - DNA, 723 bp, Homo sapiens
  misc_feature: GZ8MTXP02IW7MH.15.28.C06.1.454.CMB.2.raw
  modified_base (689)..(689): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgaccaaatgtgacatccagatcgacccagtctcccgtccaccctgtctgcatcgtggtcggagacagacgtccaccatcacgttcggcccgggtccagtcaggtagttaattaacgtaagttggttcggccttggtttcacggacaaagaaaccgacggggtaaaccaccccgaaaagttcctagattcctacctcggcccgtaccttcttacgtttacgacgtaaacggttccggggtacccagttactaacgggttacgaacggcccggacgtaggtggtaacgtcgtacgggactagtactcctacgtaccttccgaaccacgttcaccggacaccggtaccctacggacaccgtacgtaccgggttacttaacggtttacaaccgttaaactttacgttacgtaccgaaacgttagtactaactaaactaattacgtacgttacgggtacgggtaacgggaaacggggtacctaaaagggggttagaacggtacgtaaacgaaacccgtagttacggacggtcctacgtaaccggaacctttaanccgttaacggtcctttaccgtaaccgtttccccg

SEQ ID NO: 401290 - DNA, 652 bp, Homo sapiens
  misc_feature: GZ8MTXP02HPUCF.15.28.C06.1.454.CMB.2.raw
tcagtctacgtagccacgaccggtgctcgatttagagctcacgtattgggtttgggggagtcagactcagtcaggacacagcatggacatgagggtcccccgctcagctcctggggctcctgctgctctggctcccaggtgccaaatgtgacatccagatgacccagtctcccgtccaccctgtctgcatctgtcggagacagatcaccatcacttcggccggcagtcagtagtattaactaagtggttggtctggttcagcaagaaaccgaaggaaaccgaccccaaaagtcctagactctcgtcgtcccgtccttcttacgttgacgtaaagggttcgggtacctagtacgtaaggtccgaggcccggacgaggtgacgtcggtacggggaacagtaacttcgattcctacaccgataccgagacctacgccgttaacgccgtaacgtccgtagtaccgttagtttccgactaactttacactagacctaagtcaactaaattaactaacgtacgtacggtttaccgggacggtaaccgggtaaaacgtaggggtacgtaaagtaacgttaaacccgaaaaggtacgttacgggaccgttacgacgtaaccgtacgttacctcggtactttaccttacgacctttccccg

SEQ ID NO: 401291 - DNA, 684 bp, Homo sapiens
  misc_feature: GZ8MTXP02H8I0V.15.28.C06.1.454.CMB.2.raw
  modified_base (255)..(255): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttcctgttgctatttagaaggtgtccagtgtgaggtgcaactggtggagtcggtgggggagccgtcgtccgacggccggggggtcctgacgactctccgngtgagctcgtgacttcactgagctacttatggatgacgttggtccgcgacggccgtacggaggggtagggcgtaggggaggtggggtcggcccaacgtaataaacgaaaaagtagtacggaaagtacgacccaaactaacctagtacgtagaaacttcgtgtacggaacgtcggggaccctaattcccgaccttaccacccgagaccgaacggaccgaacccgtaaagaacctcctaacggtaacacttcgtaaacgaacaaacgtaacgaaacgtaacgtacggaacggacggaccggaacggacgtacggtacgttacgttagttacgttacgttacggtagtagtagtagtacgttacgtcgttcggtcgggtaaccgggtacggtaaccggtaccggtaccggtacccgtacccgtacccgtccg

SEQ ID NO: 401292 - DNA, 761 bp, Homo sapiens
  misc_feature: GZ8MTXP02FOJ48.15.28.C06.1.454.CMB.2.raw
  modified_base (283)..(283): a, c, t, g, unknown or other
  modified_base (292)..(292): a, c, t, g, unknown or other
  modified_base (350)..(350): a, c, t, g, unknown or other
  modified_base (549)..(549): a, c, t, g, unknown or other
tcagtctacgtagccacgaccggtgctcgatttagagctcacgtattggggtttgggggaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggaggtcgtgggggggaggcctcggtccgagggcccggggggggtccctggagacctctcctggtgaagcctntggattccnccttgagcacttatggatgacgtcgggtccgccaggctcggaggggaggggcgtgggngtggggcggcccaacagtaaaccaaaaaaggagtagggaaagtcgaaccgaactaaaccgttagtcgtaggtacctcgtggttggacgtcggggtccgtaacttccctaaccccggttctcccgttacaccgcccgttaccccgaacccgtaaaaccggggccccctaaggttccccgggttcccccgtttccccccgnggggtcccccgccccgtcggtcccttccccggaaagggaccggaccaacccgtaccccggaggacgacccgaaccgacgggccccggggtcccgtggggtccctcggtaccccggttacggggtaccctaaaacggggtacccctttaacccgttaaccccggtctaaaccgggttacggtaaccgttaggggacgggaccggggttaccgg

SEQ ID NO: 401293 - DNA, 700 bp, Homo sapiens
  misc_feature: GZ8MTXP02IIBM3.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttcgccgggccagtcagtagtattaactaaagtggttggccttggttcagacaacgaaaccgaagggaaacgaccccaaaagtcctagatcctcgtcgcccgtcctcttacgtttagacgtaaaagggtcggggtacccatacgtaaaggttaccgaggcccggacgaggtggacgtcggtaggggtaactaggtaactttacacgttcccttaccaaccaacttcaacgccaacggtccctcgaccacgtccgtagtaacgttagtttacgaccttaaactttaactaccgtcgtaacgtaagtacgaactaaattaaacttaacgtacgttacgggttacggggaaccggggtaacgggtaaaccggaaaaggggtacggaaacggtaaactaaacccgaaaaaccgttacggtacggttacggacgtaccgaacctaaacgttacgttaccgttacgtttacctttaccgtaacctttcccg

SEQ ID NO: 401294 - DNA, 594 bp, Homo sapiens
  misc_feature: GZ8MTXP02JO6YG.15.28.C06.1.454.CMB.2.raw
  modified_base (295)..(295): a, c, t, g, unknown or other
  modified_base (342)..(342): a, c, t, g, unknown or other
  modified_base (362)..(362): a, c, t, g, unknown or other
  modified_base (372)..(372): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctggggttttccttgttgctattttagaaggtgtccagtgtgaggtgcaactggtggagtctgggggagcctcgtccagccggggggtcctgagactctcctgtgagcctctggattcacttgagcactatggatgacttgggtccncaggctcaggggaagggctggacgtgggtggccaacataacaaaagnaggaagtgaccacaacctangtagaacttngtgagtggactatcactctacagacgacgaccgactaaacgactaccaactaacgatacctaacggaaactaaataaacgaaacaaaccgtaacgaacggaacgaccggacggaacgacggacgtagtagtagttacgttacgtagtagagtagtacgttacgttcgttcggtcggtaaccggtacggaaccggtaccgtacgtaccgtaccgtaccgtccg

SEQ ID NO: 401295 - DNA, 647 bp, Homo sapiens
  misc_feature: GZ8MTXP02G5RK4.15.28.C06.1.454.CMB.2.raw
  modified_base (388)..(388): a, c, t, g, unknown or other
  modified_base (408)..(408): a, c, t, g, unknown or other
  modified_base (412)..(412): a, c, t, g, unknown or other
  modified_base (414)..(414): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtccaccatcacgttcgccggccagtcagtatattactaagtggttggcttggttcagacaacgaaccgaaggaacaccccgaaaagtccagactctctcggaccgtccttactactttaggactaacgggtcgggtccaagtacgtaacggtcgacggcccggactagtaggactcgtaggacngtatcgagtctcacatcagngacncngacagcgtacgtacgtatttacgacttaacgttacctacgtacgtactaaggtacacttaaattaacgttaactccgttaagggtttaccggggacggggtaacgggtaaaccgggtaaagggtacggtaaacgtaaacgtaaacggtaaaaccggtagttaacgggtccgtaacgttaccggaaccctaccgtagtttccgttacggttacctttacctacgttttaccccg

SEQ ID NO: 401296 - DNA, 598 bp, Homo sapiens
  misc_feature: GZ8MTXP02JXUUE.15.28.C06.1.454.CMB.2.raw
  modified_base (198)..(198): a, c, t, g, unknown or other
  modified_base (498)..(498): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagacgtcaccatcacttcgccgggaccagtcagagtattaacgtaagtggttggcttggttacagacaagaaaccgaggaaacgaccccaaaagtcctagactctcgtcgccgtctctacttgacgaaggtcgggtaccagtactaaggttcacggtccggactaggtggaactcggtagggaacaggtaacttcgacgttctaccgaacctataccgaagcctacgcccgtagaccacgcgtagacgttactttcgacttaacttacgactcgactagtcactaataaataacgttntacgggttcggacgggtaacggacgaagggtagacgaactaaccgaaaacgtcgtaggcggactacgaaccgactatccgtatacgttccacgtttaccc

SEQ ID NO: 401297 - DNA, 789 bp, Homo sapiens
  misc_feature: GZ8MTXP02JXJXD.15.28.C06.1.454.CMB.2.raw
  modified_base (199)..(199): a, c, t, g, unknown or other
  modified_base (312)..(312): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagacgtcaccatcacttcgccggccagtcagtagtattactaaagtggttggactggttcagacaagaaaccgtagggaaacgaccccgaaaagtccctagaacgtctacncggacccgtccttacttacgtttgacgtaaaaggtcggggtacccagttaccgtaaggttcgacggacccggcgtagtacgggtactaccggtagggacctaggtaacttctaacggttcctacaaccctattaccgacgaccgttaacgtcccgtagacccgacggtaccccgttaggtaaccggtttaacgtttttacgaacccgtttaaacgtttaaaccctaaccgttaccgggtaaccctaaaagggtttacgttaaacgttaaaattaaccgtttaaccgttaacgggtttttaaccggggaaccggggttaaacccggggaacggtaaaacgggggttacggaaaggtttaaaaccgggaaactaaaacccgggttaaacggtggttaaaccggacccgttggaacccgttaaactacggtttacctaaccggtttccgtttaccgtaaccttacccggttttacccccg

SEQ ID NO: 401298 - DNA, 666 bp, Homo sapiens
  misc_feature: GZ8MTXP02GU0EQ.15.28.C06.1.454.CMB.2.raw
  modified_base (245)..(245): a, c, t, g, unknown or other
  modified_base (259)..(259): a, c, t, g, unknown or other
  modified_base (271)..(271): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtctccgtccaccctgtctgcatctgtcggagacagagtcacatcacttgccggcagtcagatattacaatgtgctgttnagcagaacaggaancccaaaagtccngatctctgccgcctctactttcgacgtaaacggtcggggtaccactacgaaggttcgagccggtctagtcggatacgtggggaactaggaaattcgagtacctactacctatcccagtacacgtcgtcgaccgtacgacctaggaaccgttacgttttacgtacctaaactttaaccacgttacggtacccgtaaaagtcggtaacctaaagtaaaatttaaacgttacctaaaggttttaccggggacggggttaaaacggggaaaccgtaaacgggggtttaacggaaagggtacttaaacccgggaaaaaccgtaaacgtttacgggacggtaaccgttggtaacccgaacccgtaagtcccttaggttcctttaccgttaactttcccccg

SEQ ID NO: 401299 - DNA, 749 bp, Homo sapiens
  misc_feature: GZ8MTXP02G7RA5.15.28.C06.1.454.CMB.2.raw
  modified_base (463)..(463): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggcctcccaggtgccaaatgtgacatccagatcgacccagtcctcccgtccaccctgtctgcactcgtggtcggagacagacgtaccacctatctacgttcggcccggacagtacaagtagttaacttaacgtaagttcgggttacggtccgttaggttacgagaccgaaaggaaacccgaacgggaaaccaccccaaaagtccagtactcctcgtacgcccgtaccttacgttacgttgaacggtaacgggtccggtacctagtacgtacggtcgaggcccgagtagtgattcggaggaacagtacttcgacgttccactaacctgaccgaancgaccgcctacgacctacgtacgtacgttaacgttgttaaccgaccttaacgttaccgtaccgtacgaccgttaaagtacgtaaactttaaactaacgttaacgttaccggttaacggggtaccggggaacggggtaaacgggtaaaccgggtaagggttaaacggaaacggtaaacgtaaaaccccggtaaaggtaacggtcgggtaaccgacgtttaaaccgcccgtaacgtttaccgttaccgttaccggtttaacccttcccggtaaccccggtttcccccg

SEQ ID NO: 401300 - DNA, 640 bp, Homo sapiens
  misc_feature: GZ8MTXP02JTU7D.15.28.C06.1.454.CMB.2.raw
  modified_base (198)..(198): a, c, t, g, unknown or other
  modified_base (248)..(248): a, c, t, g, unknown or other
  modified_base (251)..(251): a, c, t, g, unknown or other
  modified_base (263)..(263): a, c, t, g, unknown or other
  modified_base (433)..(433): a, c, t, g, unknown or other
  modified_base (587)..(587): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagacgtcaccatcacttcgccggcagtcagatatacaatggtgctgtnagnagaacaggaacncccgaaagtctgatctctcgtaccgccttctactttgacgaaggtcgggtacctagtacgtaacggttcaggacccggatacggtgacgtcgagggactagtactacgtacgtctacaacctagtacgacgacgtaccgtcgtacggctaagtcccgtagtaaaccgttnttttacggaacctaacgtttacgccttacgacccgttaaaggacttaacctaacgttaaaacttaaacgtcgttaccggtttcggggaacgtacggaaacgtacggggtagaacgtaacgaacgtaaaacggtcgtacggtacgtccggttaanaacccggtaccctagtttacggtaaccgtttcgttaaccgttaccgtttcccg

SEQ ID NO: 401301 - DNA, 675 bp, Homo sapiens
  misc_feature: GZ8MTXP02FJ7QD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgctatcgtgtcggagacagagtcaccatcacgttggcccggccagtcagagtattactaagtggtcgctggttcagcaagaaacgaggaaacgaccctaaagtctagatcctacgtcgacccgtccttacctactttcgaacgtaaacgggtccggggtaccagtacgtaaggttccgacgtccggacgtaggtaggtacgtacggtaggaacgtagtactacgtacgtcctaccacgatccgaacgtcaacggtcctagaccgtacgtacccgtaggtaccgtttaagtttcaccgtaaacctttaaacggtcctacgaccgtaaagtcgtaactaaagttaacttaactaccgttaacgggtttacccggggaagggtaaccggggtaaaccggtaaggtacggaaacgtaaagtaaacccgaaaggttaaaccgtgggtaccgacgttacaacctacgtacgtcgtttagacttacttacgtcccg

SEQ ID NO: 401302 - DNA, 631 bp, Homo sapiens
  misc_feature: GZ8MTXP02JMJBT.15.28.C06.1.454.CMB.2.raw
  modified_base (153)..(153): a, c, t, g, unknown or other
  modified_base (167)..(167): a, c, t, g, unknown or other
  modified_base (198)..(198): a, c, t, g, unknown or other
  modified_base (227)..(227): a, c, t, g, unknown or other
  modified_base (255)..(255): a, c, t, g, unknown or other
  modified_base (267)..(267): a, c, t, g, unknown or other
  modified_base (282)..(282): a, c, t, g, unknown or other
  modified_base (355)..(355): a, c, t, g, unknown or other
  modified_base (444)..(444): a, c, t, g, unknown or other
  modified_base (463)..(463): a, c, t, g, unknown or other
tcagtctacgtagccacgaccggtgctcgatttagagctcacgtattggggtttgggggggagtcagactcagtcaggacacagcatggacatgagggtccccgctcagctcctgggctcctgctgctctggctcccaggtgccaaatgtganatccagatgacccngtctccgtcaccgtgctgcagtctgtcgganacagagtcacatcacgttgccggtccatnagagtattaactaagtgtcgctgttcancagaacaggtanaccccaaaagctgantctcgacgctctatttgaccgtaaaagtcggggtaccactacaaggttacacgcggaccgtaagtgaaccgtnttacgggacgaggaagttccaaggtcttaacaccggatcagctaacggcagcaagccttaggacctaaactttgactaactacttaccnggaacttaacgagccaaanatttaaaccggggactaagtttggaccgggaaggccgaaaacggtttttcggggaacccgaattaaccgaaaggaaaacctttagtacggggtccctaggggtaacctaaccccgtttaaaacttgggggtaaaccctttcgtttacgaaacgttttacccccggggg

SEQ ID NO: 401303 - DNA, 434 bp, Homo sapiens
  misc_feature: GZ8MTXP01AMYR4.4.77.G11.1.454.CMB.2.raw
  modified_base (429)..(434): a, c, t, g, unknown or other
tcagagcactgtagcacgaccggtgctcgatttagctagtcactcaagggaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttaggttttgacaactggggacagggaaccctggtcaccgtctcctcggcctccaccagggcccatcggtcttccccctggcgccctgctccaggagcacctcccgagagcacagcgccctgggctgccctggtcaagggctactccctacagtgctctgagcgggctgggcaaggcgcatagggnnnnnn

SEQ ID NO: 401304 - DNA, 445 bp, Homo sapiens
  misc_feature: GZ8MTXP01B3IBX.4.77.G11.1.454.CMB.2.raw
  modified_base (399)..(399): a, c, t, g, unknown or other
  modified_base (402)..(402): a, c, t, g, unknown or other
  modified_base (431)..(445): a, c, t, g, unknown or other
tcagagcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttaggttttgacaacgtgggacagggaaccctggtcaccgtctcctcggcgtccaccaagggccccatcggtcttccccctggccgcccctgcctccaggacgcacctcccgagagcacagcggccctgggctgcctggtcaggctacttcccangtnctctgagcgggctggcaggcgcagtaggnnnnnnnnnnnnnnn

SEQ ID NO: 401305 - DNA, 430 bp, Homo sapiens
  misc_feature: GZ8MTXP01AE8H3.4.77.G11.1.454.CMB.2.raw
  modified_base (250)..(250): a, c, t, g, unknown or other
  modified_base (349)..(349): a, c, t, g, unknown or other
  modified_base (389)..(389): a, c, t, g, unknown or other
  modified_base (422)..(430): a, c, t, g, unknown or other
tcagagcactgtagcacgaccggtgctcgatttagctagtcactcaagggaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaggcagtgctggatccgttaggttttnacaactgggacagggaaccctggtcaccgtctcctcggcctccaccaagggccccatcggtctccccctggcgccctgcctcaggagcacctcccgagngcacagcgccctgggctgcctggtcaaggctactccctangtgctctgagcgggctggcaaggcgcatagggnnnnnnnnn

SEQ ID NO: 401306 - DNA, 519 bp, Homo sapiens
  misc_feature: GZ8MTXP01ATT2X.4.77.G11.1.454.CMB.2.raw
  modified_base (249)..(249): a, c, t, g, unknown or other
  modified_base (495)..(519): a, c, t, g, unknown or other
tcagagcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaggcagtgctggatcgttaggtttnacacgtgggacagggaaccctggtcaccgtctcctcggcgtcccaccgaacgggcccagtccggtccttcccccgtggcccgccctggcctccgaggacgccacctccccgagacgcacgacggccggccctggggcctcggcccgtgggtaccaaacgggtaccttacccgttcccctaacgacggttcgaccttcgtacgggacggtccggggtctcgggacgaaacgggccgacagtaggggnnnnnnnnnnnnnnnnnnnnnnnnn

SEQ ID NO: 401307 - DNA, 544 bp, Homo sapiens
  misc_feature: GZ8MTXP01B6LBG.4.77.G11.1.454.CMB.2.raw
  modified_base (252)..(252): a, c, t, g, unknown or other
  modified_base (508)..(508): a, c, t, g, unknown or other
  modified_base (510)..(510): a, c, t, g, unknown or other
  modified_base (512)..(512): a, c, t, g, unknown or other
  modified_base (514)..(514): a, c, t, g, unknown or other
  modified_base (516)..(533): a, c, t, g, unknown or other
  modified_base (535)..(544): a, c, t, g, unknown or other
tcagagcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaggcagtggctggatccgttaggttttnacacgtgggacagggaaccctggtcaccgtctcctcggcctccaccgaagggccccagtcggtccttccccctggccgccctgctccgagacgcacctcccgagacgcacagccggcccgtgggcctcggcccgtaggtacccgaaagggtacccttaaaccctttccccccgtaagtacggttccggccttccgttgggaacggtcccgggggacttcggggacccgaaaagggggcccgacttaagtaaggggngngngngnnnnnnnnnnnnnnnnnngnnnnnnnnnn

SEQ ID NO: 401308 - DNA, 462 bp, Homo sapiens
  misc_feature: GZ8MTXP01ELYY9.4.77.G11.1.454.CMB.2.raw
  modified_base (344)..(344): a, c, t, g, unknown or other
  modified_base (358)..(358): a, c, t, g, unknown or other
  modified_base (362)..(362): a, c, t, g, unknown or other
  modified_base (407)..(407): a, c, t, g, unknown or other
  modified_base (447)..(462): a, c, t, g, unknown or other
tcagagcactgtagcacgaccggtgctcgatttagctagtcactcaagggaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtatactgtgcgagagaccgaggaggcagtgctggatcgttaggtttgacagtgggacagggaaccctggtcaccgtctcctcggcctccaccaagggcccctagtccggtccttcccccgtggccgcccctgcctccgaggacncacctccccgagancacncgcccggcctgggctgccgtggtccaacgggcttaccgttcccanagtcgctcgtgacggcgggctgggcaaggcgtacagaggnnnnnnnnnnnnnnnn

SEQ ID NO: 401309 - DNA, 463 bp, Homo sapiens
  misc_feature: GZ8MTXP01B8ZV7.4.77.G11.1.454.CMB.2.raw
  modified_base (194)..(194): a, c, t, g, unknown or other
  modified_base (233)..(233): a, c, t, g, unknown or other
  modified_base (253)..(253): a, c, t, g, unknown or other
  modified_base (258)..(258): a, c, t, g, unknown or other
  modified_base (276)..(276): a, c, t, g, unknown or other
  modified_base (281)..(281): a, c, t, g, unknown or other
  modified_base (302)..(302): a, c, t, g, unknown or other
  modified_base (306)..(306): a, c, t, g, unknown or other
  modified_base (309)..(310): a, c, t, g, unknown or other
  modified_base (312)..(312): a, c, t, g, unknown or other
  modified_base (317)..(317): a, c, t, g, unknown or other
  modified_base (327)..(327): a, c, t, g, unknown or other
  modified_base (331)..(331): a, c, t, g, unknown or other
  modified_base (333)..(333): a, c, t, g, unknown or other
  modified_base (439)..(440): a, c, t, g, unknown or other
  modified_base (442)..(463): a, c, t, g, unknown or other
tcagagcactgtagcacgaccggtgctcgatttagctagtcactcaaggggaaaggggctggaatggctttcatacattactagcagtggtacagcatactacgcagagtctctgcagggccattcaccatctccagggacaacgccaagaactcgctatatctaggaaatgaacagcctgagagtcgaggacncggcctgtattactgtgcgagagacgaggaggcagtggntggatcgttggtttgacagnggganaggacctgcacgtctccncgccncaccaggccatcgtcctcccngccnccnncncagcncacctccganagcncncgaccggccctgggctcggcctggtacaacggaccgttaaccttccctaacgtgtacgcctcgtaggacgggtcgggactcgggacgaacgggcgacaagtggggnngnnnnnnnnnnnnnnnnnnnnnn

SEQ ID NO: 401310 - DNA, 433 bp, Homo sapiens
  misc_feature: GZ8MTXP02HJTQE.4.77.G11.1.454.CMB.2.raw
  modified_base (394)..(394): a, c, t, g, unknown or other
  modified_base (421)..(421): a, c, t, g, unknown or other
  modified_base (428)..(433): a, c, t, g, unknown or other
tcagagcactgtagcacgaccggtgctcgatttagctagtcactcaagggaagggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttaggttttgacaactgggacaggaaccctggtcaccgtctcctcggcctccaccaagggcccatccggtcttccccctggcgccctgctccaggagcacctcccgagagcacagcggccctgggctgcctggtcaaggactacttccctanagtgctctgagcggggctggcaaggcncgatagnnnnnn

SEQ ID NO: 401311 - DNA, 423 bp, Homo sapiens
  misc_feature: GZ8MTXP02HN6CZ.4.77.G11.1.454.CMB.2.raw
  modified_base (319)..(319): a, c, t, g, unknown or other
  modified_base (322)..(322): a, c, t, g, unknown or other
  modified_base (332)..(332): a, c, t, g, unknown or other
  modified_base (343)..(343): a, c, t, g, unknown or other
  modified_base (348)..(348): a, c, t, g, unknown or other
  modified_base (385)..(385): a, c, t, g, unknown or other
  modified_base (389)..(389): a, c, t, g, unknown or other
  modified_base (392)..(392): a, c, t, g, unknown or other
  modified_base (416)..(423): a, c, t, g, unknown or other
tcagagcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttaggttttgacaactggggacagggaaccctggtcaccgtctcctcggcctcaccaggcccatcggtctccccngcncctgctcagncacctccgagngcacngccggcctggggctgcctggtcaaggctactccctanagtnctntgagcgggctggcaggcgcagtgnnnnnnnn

SEQ ID NO: 401312 - DNA, 498 bp, Homo sapiens
  misc_feature: GZ8MTXP02I6NAI.4.77.G11.1.454.CMB.2.raw
  modified_base (476)..(498): a, c, t, g, unknown or other
tcagagcactgtagcacgaccggtgctcgatttagctagtcactcaagggaaaggggctggaatggctttcatacattactagcagtggtacagcatactacgcagagtctctgcagggccattcaccatctccagggacaacgccaagaactcgctatatctggaaatgaacagcctgagagtcgaggacacggccctgtattactgtgcgagagaccgaggaaggcagtggctggattccgttaggtttgacagtggggacaggacctggtcaccgtctcctcggccctccaccgacgggccccagtccggtcccttcccccgtggcccgccctcgcctccgaggacgccacctcccgagacgccacgacgccggcccgtggggcctcggccctgggtaccaaacgggtccttccttcccctagacggtcgccttcgtggacggccggggctgggaccgaagggcgacagtagnnnnnnnnnnnnnnnnnnnnnnn

SEQ ID NO: 401313 - DNA, 522 bp, Homo sapiens
  misc_feature: GZ8MTXP02G946S.4.77.G11.1.454.CMB.2.raw
  modified_base (206)..(206): a, c, t, g, unknown or other
  modified_base (323)..(323): a, c, t, g, unknown or other
  modified_base (328)..(328): a, c, t, g, unknown or other
  modified_base (344)..(344): a, c, t, g, unknown or other
  modified_base (359)..(359): a, c, t, g, unknown or other
  modified_base (495)..(495): a, c, t, g, unknown or other
  modified_base (497)..(522): a, c, t, g, unknown or other
tcagagcactgtagcacgaccggtgctcgatttagctagtcactcaagggaaaggggctggaatggctttcatacattactagcagtggtacagcatactacgcagagtctctgcagggccattcaccatctccagggacaacgccaagaactcgctatatctggaaatgaacagcctgagagtcgaggacacggcctgtattacngtgcgagagacgaggaaggcagtggctggatccggtttaggttttgactagtggggacacggacctggtccaccgtctcctcggcctccaccgacgggcccagtccgtcctccccgnggccnccctgcctccgaggcnccgacctcccgacgngccacgacggcccggcccgttggggcctcggccgtgggtaccgaaacgggtaccttacccgtttccccacgtacggtcgtccgttcgcgggacgggccggggtcgtacggggaccgaacggggccgatacgtaggngnnnnnnnnnnnnnnnnnnnnnnnnnn

SEQ ID NO: 401314 - DNA, 579 bp, Homo sapiens
  misc_feature: GZ8MTXP02F6FNA.4.77.G11.1.454.CMB.2.raw
  modified_base (378)..(378): a, c, t, g, unknown or other
  modified_base (547)..(547): a, c, t, g, unknown or other
  modified_base (549)..(549): a, c, t, g, unknown or other
  modified_base (551)..(579): a, c, t, g, unknown or other
tcagagcactgtagcacgaccggtgctcgatttagctagtcactcaaggggaaaggggctggaatggctttcatacattactagcagtggtacagcatactacgcagagtctctgcagggccgattcaccatctccagggacaacgccaagaactcgctatatctaggaaatgaacagcctgagagtcgaggaccacggccctgtattactgtgcgagagaccggaggaaggcaggtgcgtggattcggtttagggttttcgacgacggtggggacgacgggtacccgtggtaccaccgtctccgtccggccctccgaaccgacgggcccctacgtccggtcccttccccgcggcccgcccgtgcctccggacggacnccctaccgtaccccgacgacgacaccgacggccccggtcccggtggggcctaccggccggttacgggaccgtaaacggtacccttacccttacccgtaacgtcgttcgccgttcgtaggacggggcccgggtcggttaccgggacgggaaacgggccgaagtagtacgngngnnnnnnnnnnnnnnnnnnnnnnnnnnnnn

SEQ ID NO: 401315 - DNA, 505 bp, Homo sapiens
  misc_feature: GZ8MTXP01EEYJX.3.25.C03.1.454.CMB.2.raw
  modified_base (240)..(240): a, c, t, g, unknown or other
  modified_base (303)..(303): a, c, t, g, unknown or other
  modified_base (345)..(345): a, c, t, g, unknown or other
  modified_base (457)..(457): a, c, t, g, unknown or other
  modified_base (482)..(482): a, c, t, g, unknown or other
tcagagacgcactccacgaccggtgctcgatttagtagtgtagatttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcacccaggacaaacgcccccaaatcaatgatttangaggtcaacaaagcggccctcgaggggtccctgatcgcttcnctgcctccaaagtctggcaaacacggcctccctgaccgtctctggctccagcctgagatgaggctgattatactggcagctcatatgcaggctatacaaactctgtttcggnggagggaccaagtcttgaccgttcnggtcaagcccaggctcgccctcg

SEQ ID NO: 401316 - DNA, 533 bp, Homo sapiens
  misc_feature: GZ8MTXP01CNNM2.3.25.C03.1.454.CMB.2.raw
  modified_base (310)..(310): a, c, t, g, unknown or other
  modified_base (515)..(515): a, c, t, g, unknown or other
  modified_base (517)..(533): a, c, t, g, unknown or other
tcagagacgcactccacgaccggtgctcgatttagtagtgtagatttgggtttggagatggttttctcgatgggggctgggagggctttgttggagaccttgcacttgtactccttgccattcagccagtcctggtgcaggacggtgaggacgctgaccacacggtacgtgctgttgtactgctcctcccgcggtcttttgtcttggctattatgcacctcacgccgtccacgtaccagttgaacttgacctcgagggttcttcgtggctcacgtccaccaccacgcatgtgacctcgaggggtccgganatcagtggaggtgtcgtttggggtttgggggaagagggaagacgtgaccggtcccccgaggacgttccgagggtcgcgtgggccaacgaggccgggcccgtgggggcctggcccgtgggtacaaacgggtaccttaccgttccggaggttggccgttcgtcgttggacggcggggtctcggggacaaaggggccgacggataggngnnnnnnnnnnnnnnnnn

SEQ ID NO: 401317 - DNA, 397 bp, Homo sapiens
  misc_feature: GZ8MTXP02G4OG3.3.25.C03.1.454.CMB.2.raw
  modified_base (392)..(397): a, c, t, g, unknown or other
tcagagacgcactccacgaccggtgctcgatttagtagtgtagatttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaggctggcccctcggtcactctgttccccacctcctcgagtcgcgtctctgagcgggctgggcaaggcgcatagnnnnnn

SEQ ID NO: 401318 - DNA, 519 bp, Homo sapiens
  misc_feature: GZ8MTXP02GIRLP.3.25.C03.1.454.CMB.2.raw
  modified_base (206)..(206): a, c, t, g, unknown or other
  modified_base (388)..(388): a, c, t, g, unknown or other
  modified_base (406)..(406): a, c, t, g, unknown or other
tcagagacgcactccacgaccggtgctcgatttagtagtgtagatttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttatgaggtcacaaagcggccctcaggggtccctgatcgcttctctgcctccaagtctggcaacacggcctcctgaccccgtctctgggctcagcctgaggatgaggctgattattactgcagntcatatgcaggcatcaanactgttttcggcggagggacaagctgacgtccttaggcagccaacggcccgccgcccgtccgtctactccgtccgtcccgtcccgtccgtcgtcgtcgtcgtcgtcgcggcgg

SEQ ID NO: 401319 - DNA, 542 bp, Homo sapiens
  misc_feature: GZ8MTXP01DQ77W.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtcctgagtgctgcctcttgtcgccccacagctgaagcagacgccctaccaaaactcctcatctaatggtaaaccagacaatccggccctacgacggggtcccctgaacccgtattctctgggcctaccaagtctggccacctcacgccctccctggtcacgtcgcgtcgggcctccgaggcgtagacgatgaggctagtattattattcgcctaagtccttatcgacaacctaccttgttcgttggttttggcttcggttcggcggcggtaaccgaagtccg

SEQ ID NO: 401320 - DNA, 569 bp, Homo sapiens
  misc_feature: GZ8MTXP01EPRJ6.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcctgagtgctgcctcttgtcgcccanagctgaagcagacgcctacccaaactcctacatctataggtaaaccagacaatccggcccctacgacggggtccctgacccgtattctcgtgggcctaccaagtctggccacctcacgtccccttcccgtggtccacgttccgcgtcggggcccttccggggacgggtcgtacggacgaagtggagggtctagtatttattattcgctaagtccttatcgactaactacccgttgttcgttggttttggcgttcggttcgggcggcgggtaaccgaagtccg

SEQ ID NO: 401321 - DNA, 514 bp, Homo sapiens
  misc_feature: GZ8MTXP01EFJJO.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagccctccaaactcctcatctatggtaaaccagcaatccggccctcgacgggggtccctgacccgtattctctggctccaagtctggcactcagcctcctgtcatcgctgggctcgaggctgacgatgaggctgtattattattgcctaagtccttatcgacaactacccttgttcgttggttttggcttggttcggcggcgggtaaccgaagtccg

SEQ ID NO: 401322 - DNA, 410 bp, Homo sapiens
  misc_feature: GZ8MTXP01BX43A.21.25.C03.1.454.CMB.2.raw
  modified_base (370)..(370): a, c, t, g, unknown or other
  modified_base (404)..(410): a, c, t, g, unknown or other
tcagtcgtcgctcgcacgaccggtgctcgatttagtagtgtagatttgggtttgggagcagctccaacatcgggtcacctttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggaccaagctgaccgtctaggtcagcccaggcctcgccccctcggtccactctcgttccccgccctcctccgngcgacgactgagcgggctgggcaaggcgcatagnnnnnnn

SEQ ID NO: 401323 - DNA, 564 bp, Homo sapiens
  misc_feature: GZ8MTXP01EO23V.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctaccaaactcctcatctatggtaaaccaggacaacgtcccggcccctacgacgggggttcccctagacccgtaatttcctcgtgggccttaccaagtcgtcggcaccctcacgtccctcccttcggtccacgtcgcgtcgggcctccggaggtctgacgatggaggctagtattattattcgctaagtccttatcgttaacaacctacccgttgttccggttggttttggcttggttcgggcgggcggtaaccgaagtccg

SEQ ID NO: 401324 - DNA, 529 bp, Homo sapiens
  misc_feature: GZ8MTXP01C22YP.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgtcctgagtgctgcctcttgtcgccccanagctgaagcagacgccctaccaaaactcctacatctatcggtaaaccagacaacgtccggccctacgacggggtccctgaccgtattctctggcctcaagtctggcacctcacgtccctccctggtcactcgcgtcgggcctcggagctgacgagtgaggctagtattagtattcgctaagtccttatcgactaactacccttgttcgttggttttgcttgttcggcggcggaacttaaggcg

SEQ ID NO: 401325 - DNA, 610 bp, Homo sapiens
  misc_feature: GZ8MTXP01C2SFL.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccacagctgaagcagacgcctacccaaactcctacatctataggtaacccagcaagtcccggccctacgacgggggtcccctagacccgtatttcctcgtgggcctacccgaagtctcggccacctcacgcccttcccgtggtccacgtccgcgtcgggccttccggacggcgtgacgatggacggtcttagatttagttattcgtccgtaagttcccttagtacgaacctaaaccgtcccgttcggttccggtttgggttttttcgggtccgtttggggtttcccggggccggggttaccgggggtaacccgttaacgggtcccgg

SEQ ID NO: 401326 - DNA, 659 bp, Homo sapiens
  misc_feature: GZ8MTXP01D46J8.21.25.C03.1.454.CMB.2.raw
  modified_base (289)..(289): a, c, t, g, unknown or other
  modified_base (346)..(346): a, c, t, g, unknown or other
  modified_base (457)..(457): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagattgtcctgagtgctgcctcttgcgccccaanagctagaaacgcaagacgcccctacccaaaactcctacatactaatacggtaaaccnggacaaacgtcccggccctaacggacggggtccctagaacccgtatttccgtcgtacggccttacccgaagtccgtcggaccaccctcaccgtccccttccgtcggtaccncgtccgtcggtcggtcctaccgggacggtctacggacgtagtcggtacgtacgttagttaactttaacttaacttaaccgtacgttaacctaattaaccgtaaaccttaaacccgtaccgttcggttaccgggttttgggttttcggtcggttcgggtccggggccgggtaccgggttaaccgtaacggttccgtaaccggg

SEQ ID NO: 401327 - DNA, 609 bp, Homo sapiens
  misc_feature: GZ8MTXP01DWMHB.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccaacagctagaagcaagacgccctaccaaactcctcattctatcggtaaaccagacaacgtcccggcccctacgacgggggtcccctaggacccgtatttcctcgtcgggcctacccaagttccgtggccaccctcacgcccttcccgtggtcacgtccgcgtcggggccttccggaacgggtcgtacggaccgagtggaggtcttagtatttagttattcggcctaacgttccttagtcgaactaaaccctcccgttggttcggtttgggttttcggcgtttcgggttccggggcgggttaccggggtaaccttaacggtcccg

SEQ ID NO: 401328 - DNA, 572 bp, Homo sapiens
  misc_feature: GZ8MTXP01D0F7O.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagatgaagcagacgccctaccaaactcctacatctatacggtaaaccagacaagtccggccctacgacggggtcccctgacccgtattctctgggcctacaagtctcggcaccgtcacgtccctccgtggtcacgtccgcgtcgggcctccggacggctacgacgagtggaggtcgtagtatttattacgttcgcctaacgtccttatcgaacctaaaccgtacccttggttcgtttgggttttcggcgttcgggttccgggcgggaccgggtaacccgaagtcccg

SEQ ID NO: 401329 - DNA, 512 bp, Homo sapiens
  misc_feature: GZ8MTXP01DVQIG.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtcctgagtgctgcctcttgtgccccacagctgaagcagagcctccaaaactcctcatctatggtaaaccagcaaatcggccctcgacggggtccctgaccgattctctggctcaagtctggcacctcacgtccctcctggtcatcgctgggctccgaggctgacgatgaggctgtattattattgcctaagtccttatgacaacacccttgcgttggttttggcttggttcggcggcgggtaaccaagtccg

SEQ ID NO: 401330 - DNA, 761 bp, Homo sapiens
  misc_feature: GZ8MTXP01DLCJ8.21.25.C03.1.454.CMB.2.raw
  modified_base (262)..(262): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcngagtgctgcctcttgtcgcccacagctgaagcagacgcctaccaaactcctacatctaagtacggtaaacccaggacaaacgtccggaccccgtacgaacgggggttcccctaggaacccgtactttccgtccgttcgggacctacccgtaaacgttccgtacgggccctaaccctccgaaccgtccccgttccccgttcgggttacctaacgttcccggtccgtcgggggtcccttaccccggggagggtacccgttacgggaacccggtacgttagggaacggggtcctttagggttaaatttttaacgtttaacgtttccggtacccctaaacgggtttacccttaaacgtttaccggaaaccctaaaacccgtacccccggtttggggtttcccgggtttttgggggtttttttcgggtcccggttttccgggggtttcccgggggacccgggggttacccgggggtaaacccgttaaccgggtttaaccccggg

SEQ ID NO: 401331 - DNA, 578 bp, Homo sapiens
  misc_feature: GZ8MTXP01D3159.21.25.C03.1.454.CMB.2.raw
  modified_base (394)..(394): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccacagctagaacgcaagacgccctaacccaaaactcctacaattcctaaagtcggtaaacccaggacaaacgtcccggccccttacgacggggtccctgacccgtattcncgtcggctaccagtctggcctacctcacgtccctcccgtggtcacgtccgtcgtcgggcctccggaggtctagacgagtgagtctagtattattacttcgcctaagtccttatacgaaccgaactcccgttggttcggtttggttttcgcgttgggttcgggcgggacggtaaccgaagtcccg

SEQ ID NO: 401332 - DNA, 547 bp, Homo sapiens
  misc_feature: GZ8MTXP01E2ZRG.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccacagctgaagcaagacgccctacccaaaactcctacatctaatacggtaaaccaggacaaagtccggcccctacgaacgggggtcccctgacccgtattcctcgtggcctaccaaagtctcggccacctcacgcccctccctggtccatcgcgtgggcctccggaggctgacgagtgaggctgtattattattcgcctaagttccttatacgaactaacacccttgttcgttggttttgcttggtcggcggcggaacgaagtcg

SEQ ID NO: 401333 - DNA, 517 bp, Homo sapiens
  misc_feature: GZ8MTXP01AW51A.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagcctccaaactcctcatctatggtaaacccagcaatccggcccctacgacgggggtcccctgacccgtatttcctctgggcttaccaagtctggcacctcacgcctccctggtcatcgctgggctccgaggctgacgatgaggctgattattattcgccaagtccttatcgacaacacccttgttcgttggttttgctgttcggcggcgggtaacaagcg

SEQ ID NO: 401334 - DNA, 550 bp, Homo sapiens
  misc_feature: GZ8MTXP01D7G0R.21.25.C03.1.454.CMB.2.raw
  modified_base (319)..(319): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtcctgagtgctgcctcttgtcgccccacagctgaaagcagacgcctaccaaaactcctnatctatggtaaaccagacaaagtccggcccctacgaacgggggttcccctagacccgtatttccgtctcgggcctaccaagtctcggccacctcacgccctcccgtggtcatcgctcgggcctccgaggctgacgatgaggctagtattattattcgcctaagtccttatcgacaactacccttgttcgttggttttggcgttggttcgggcggcgggtaaccgaagtccg

SEQ ID NO: 401335 - DNA, 509 bp, Homo sapiens
  misc_feature: GZ8MTXP01BZ8F3.21.25.C03.1.454.CMB.2.raw
  modified_base (464)..(464): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgcccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagcctccaaactcctcatctatggtaaccagcaaatccggccctcgacggggtccctgacccgattctctggctccaagtctggcacctcacgccctcctggtcatcgctgggctccgaggctgacgatgaggctgattattattgcctaagtccttatcgacaacncccttgttcgttggttttgcgtgttcggcggttcgggcgaagtcg

SEQ ID NO: 401336 - DNA, 630 bp, Homo sapiens
  misc_feature: GZ8MTXP01CX1VA.21.25.C03.1.454.CMB.2.raw
  modified_base (267)..(267): a, c, t, g, unknown or other
  modified_base (294)..(294): a, c, t, g, unknown or other
  modified_base (326)..(326): a, c, t, g, unknown or other
  modified_base (386)..(386): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccagtgcgtggagattgtccnggagtgctgccttcgttgtcgccccangctagaagcagacgccctacccaaactcctanatctagtacggtaaaccaggacaagtcccggccctacggacggggtccctacgaaccgtntttcctcgtcggcctacccgtaagttccgtcggaccctacctccgtacgtccccttcccgtcggtcctacgtccgcgtcggggccctaccgggaggtccgtgaccgagtcggacggtcttagtaatttattacttcgcctaacgtccttaagtaccaaccgtaaacctcccgttggttcgggttttcggttttcgggtccgttcgggttccgggccggggttaccggtaaccgttaacggtccg

SEQ ID NO: 401337 - DNA, 717 bp, Homo sapiens
  misc_feature: GZ8MTXP01DVPHJ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgcgccccacagctagaagcaagacgccctacccaaaactccctacaacttctaagtacggtaaacccaggactaaacgtcccgggaccccttaacggacgggggttcccctaggaacccggtatttccgtcgttcggggacctacccgtaaagttccgtacgggccaacccttccaaccggtccccttccccgttgggttccaacgttccgcgttcgggggccccttaccgggaacgggtcccgttaggaacccgaaagttggaaacgggttcgttaagttaactttaacgttacgttccgtaccgttaacgttaccttaacgtaaccgaaacccgtaaacccgttacccgtttgggtttccgggttttcggggttttcgggtccggtttccgggttcccggggacccgggttaaccggggtaacccgttaacggtcccg

SEQ ID NO: 401338 - DNA, 542 bp, Homo sapiens
  misc_feature: GZ8MTXP01CCMAK.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgggagattgtcctgagtgctgcctcttgtcgccccacagctgaagcagacgccctaccaaactcctacatctatggtaaaccaggcaagtccggccctacgacggggtccctgacccgtattctcgtcggcctaccaacgtctcggccaccctcacgccctcccgtggtcacgttcgcgtcgggcctccggaggtctgacgagtgaggctgtattattattcgcctaacgtcttatcgacaaacctccttgttcgttggtttggcttggtcggcggcggtaaccgaagtcg

SEQ ID NO: 401339 - DNA, 576 bp, Homo sapiens
  misc_feature: GZ8MTXP01ECOKP.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccacagctagaagcagacgcctaccaaactcctacatctatcggtaaccagacaagtccggccctacgacggggtccctgacccgtattcgtcgtgggcctaccgaacgtcgtcggcaccgtcacgtcccttcccgtggtcacgtcgcgtcgggcctcggaggtctggacgagtgaggtctagtatttattagttcgctaacgtccttatcgaacaaacctacccgttgttcggtttcgggtttttcggcgtttcgggttccgggcgggaccgggtaaccgttaacggtcccg

SEQ ID NO: 401340 - DNA, 581 bp, Homo sapiens
  misc_feature: GZ8MTXP01CJI6L.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccacagctagaagcagacgccctacccaaactcctacatctaagtcggtaaaccagacaagtcccggccctacgacggggtcccctggacccgtattccgtcgtcggcctaccgtaacgtcctcggccacctccacgtcccttcccgtggtccacgtccgcgtcggggcctccggacggtcgtgacgagtgagtcgttagtattattattgcctaagttccttatcgaacctaaacctcccgttggttccggtttgggttttggcgttcgggttcgggcggcgggtaaccgaacggtccg

SEQ ID NO: 401341 - DNA, 707 bp, Homo sapiens
  misc_feature: GZ8MTXP01EHGVC.21.25.C03.1.454.CMB.2.raw
  modified_base (263)..(263): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcngagtgctgcctcttgtcgcccanagctagaagcaagacgccctacccaaaacttcctacaattctaagtacggtaaacccaggacaaacgttcccgggaccccctaacggaacgggggttcccctaggtaaacccgtatttccgtccgtcggggaccttacccgtaaagttccgtacgggacccaacccttccgaacggtcccccttccccgttgggttacccaacgttcccggccgttcgggggacccttccccgggaaggggtccgttacgggaaccgtaagttcgggaacgggtccttaggtaacttttaagttaagtttccggaccctaacggttacccttaagttacgaaacctaaaccgtaccccgttggttccggtttgggtttttcggcgtttcgggttccggggcgggttaccgggaacccgttaacggtcccgg

SEQ ID NO: 401342 - DNA, 560 bp, Homo sapiens
  misc_feature: GZ8MTXP01ANZOV.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtcctgagtgctgcctcttgtgccccacagctgaagcagacgcctaccaaactcctacatctatcggtaaaccagcaagtccggccctacgacgggggtccctgaacccgtattctcgtcggctacccaagttctcggaccaccctccacgtccccgttcccgtggtccacgtccgcgtcgggcctccggaggctgaccgatgagctgtattagttattcgcctaagtccttatcgactaacctacccgttgttcgttgggttttggcgttcggttcgggcggcgggtaaccgaaggtccg

SEQ ID NO: 401343 - DNA, 718 bp, Homo sapiens
  misc_feature: GZ8MTXP01B9N57.21.25.C03.1.454.CMB.2.raw
  modified_base (277)..(277): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccgaggccatgctggagattgtctgagtgctgcctnttgcgcccangctgaagcagacgcctaccaaactcctacatctaagtacggtaaacccaggacaaacgttccccggaccccttaacgggaaccgggggttccccctaggtaaaccccggtacttttcccgtccgtcggggtacccttacccgtaaacggttccgtacgggccctaacccttccgaccggtccccttccccgtgggtcctacgtccggtcgttcggggcccttaccggggacgggtccgtacggaacggtaagttcggaacgggtcttaaggttattttaaagtttacgttcggtccctaaacggttccttaacgttaccggaaccctaaaacccgtccccgtttggttcccggttttggggttttttcgggcggtttccgggtttcccgggggccggggttacccggggtaacccgttaacggttccccgg

SEQ ID NO: 401344 - DNA, 564 bp, Homo sapiens
  misc_feature: GZ8MTXP01C13L0.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtctgagtgctgcctcttgtgccccanagctgaagcagacgccctaccaaactcctacatactatacggtaaaccagacaagtccggccctcgacggggtccctgacccgtattctctggctaccaagtctggcacctcacgccctcccgtggtcatcgcgtcgggcctcggaggtctgacgtagtgaggtctagtactttattagttcgcctaagttcccttagtacgaacctaaccgtacccttggttcggtttgggttttcggcgttgggttccgggcgggttacgggtaaccgaaggtccg

SEQ ID NO: 401345 - DNA, 623 bp, Homo sapiens
  misc_feature: GZ8MTXP01B8VGI.21.25.C03.1.454.CMB.2.raw
  modified_base (272)..(272): a, c, t, g, unknown or other
  modified_base (335)..(335): a, c, t, g, unknown or other
  modified_base (354)..(354): a, c, t, g, unknown or other
  modified_base (398)..(398): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgcccgtcggggccccagacaccggagggcggctgcgtcagcacagacgtcgggcccaggaccctgtgcagtgagcgaggagagtgaggaggagaggagacgaggccagtgcgtggagtattcgtcnggagtgctcgccttcgttgcgccccagagctagaacgcaacgacgccctaaccaaactcctanatctaagtacggtaaaccngacaacgtcccggccctaacgggacgggtccctagtaacccgtnttccgtcgtcgggtacctaccgtaacgtccgtcggaccctaccctcgaccgtccccttcccgttggcctacgtcgtcggtcgggtcctcgggacggtcgtacgacgtagtgacgtctagttattattactcgcctaagtccttatacgaacctaaccgtccgttggttcggtttcggttttcggcggttcggtccgggaccgggaccggtaaccgaacgtcccgg

SEQ ID NO: 401346 - DNA, 583 bp, Homo sapiens
  misc_feature: GZ8MTXP01D4WE9.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccanagctgaagcaagacgccctacccaaactcctactatctaatcggtaaacccaggacaagtcccggcccctacgacggggtccctgaccgtattctctggctccagtctggcacctcacgtccctccgtgtccagttccgcgtcggggcctccggacggtctcggacgagtcggaggtcttagtatttattattcgcctaacgttccttatacgaacctaaccgtacccttggttcggtttgggttttcggtcgttcgggttccgggccgggttccggggtaaccgttaacggtccg

SEQ ID NO: 401347 - DNA, 533 bp, Homo sapiens
  misc_feature: GZ8MTXP01BRNCQ.21.25.C03.1.454.CMB.2.raw
  modified_base (263)..(263): a, c, t, g, unknown or other
  modified_base (485)..(485): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtccngagtgctgcctcttgtcgcccacagctagaagcagacgccctaccaaactcctcatctatggtaaaccagacaatccggccctcgacggggtccctgaaccgtattctcgtcggctcccaagtctcggccacctcagccacttcccctggtccactcgcgtcgggctccgaggctgacgagtgaggctgtatttattattgcctagttcctattgaacaacncccgttgttcgttggttttggcttggttcggcggtcggttaacgaacg

SEQ ID NO: 401348 - DNA, 620 bp, Homo sapiens
  misc_feature: GZ8MTXP01AJRU9.21.25.C03.1.454.CMB.2.raw
  modified_base (260)..(260): a, c, t, g, unknown or other
  modified_base (282)..(282): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctggagatgtcngagtgctgcctcttgcgcccanagctgaagcagacgcctaccaaactcctcaatctaagtacggtaaaccaggactaaacgtcccggacccttaaccggaaccgggggttcccctaggtaccccgtatttcccgtcgttcggaccttacccgaacgttcgtacggacctaccctccgacggtcccctcccgtggtccacgtccgtcgtcgggccctccgggaggtcgtacgacgagtggagtctaaggtatttattacgtcgcctaagtccttagtcgaacctaaaccgtccgttggttcggtttcgggttttcggcgttcggttcccggggcgggaccgggtaaccgttaacgtcccgg

SEQ ID NO: 401349 - DNA, 510 bp, Homo sapiens
  misc_feature: GZ8MTXP01CDW7B.21.25.C03.1.454.CMB.2.raw
  modified_base (285)..(285): a, c, t, g, unknown or other
  modified_base (473)..(473): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagagagaccaggccatgctggagattgtcctgagtgctgcctcttgtgccccanagctgaagcagacgccctaccaaactcctcatctatggtaaccagcaatccggaccctcgacggggtccctgacccgtattctctgggctaccaagtctggcaccgtcacgcccttcccgtggtcatcgctgggcctccgaggctgacgagtgagctgattatattcgctaagtccttatcgacaacnccttgcgttgtttgcgtgttcggcggcggcgaagtcg

SEQ ID NO: 401350 - DNA, 527 bp, Homo sapiens
  misc_feature: GZ8MTXP01BTTP8.21.25.C03.1.454.CMB.2.raw
  modified_base (287)..(287): a, c, t, g, unknown or other
  modified_base (478)..(478): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgggagattgtcctgagtgctgcctcttgtgccccanagctgaagcagacgccctaccaaactcctcatctatggtaaaccagcaagtccggccctacgacgggggtcccctgacccgtattcctcgtggctccaagtctggcacctcacgccctccctggtcatcgcgtgggcctccgaggctgacgatgaggctgattattattcgcaagtccttatcgactaacncccttgttcgttggtttgcgtggttcggcgggttcggaaccgaagtccg

SEQ ID NO: 401351 - DNA, 408 bp, Homo sapiens
  misc_feature: GZ8MTXP01BY1WC.21.25.C03.1.454.CMB.2.raw
  modified_base (355)..(355): a, c, t, g, unknown or other
  modified_base (366)..(366): a, c, t, g, unknown or other
  modified_base (400)..(408): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattatgccagtcctatgacaacaccctgcgtggttttgctgttcggcggcgggaccaagctgaccgtctaggtcagccaaggctcgcccctcggtccactctcgtcccnccctcctccgngcgacgactgagcggggctggcaaggcgcatagnnnnnnnnn

SEQ ID NO: 401352 - DNA, 677 bp, Homo sapiens
  misc_feature: GZ8MTXP01ESM9M.21.25.C03.1.454.CMB.2.raw
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtccgtgagtgctgtcctcttgtcgcccanagctagaagcaagacgccctacccaaaaccttcctacacttactaagtacggtaaacccaggtactaaacgtcccggaccccctacgggaaccggggttcccctggtaacccgtactttccgtcgtcgggccttaccgaacgttccgtcggcctaacccgtcctaacgtccccgttcccgttcgggtcctacgttccgtcgtcggggtcccttaccgggacggtcgtagtaccggtaagtcggacggtcgttagtatttaagtttacgttcgtacctaacgttccttatacgttaacctaaaccgtacccgttcgggttcggtttcgggtttttcggcgtttcgggttccggggccggggttaccggggtaaccgttaacgggtcccg

SEQ ID NO: 401353 - DNA, 533 bp, Homo sapiens
  misc_feature: GZ8MTXP01D4SK1.21.25.C03.1.454.CMB.2.raw
  modified_base (436)..(436): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggcccccagacaccgagggcggctgcgtcagcacagactggggcccaggaccctgtgcagtgagcgaggagagtgaggaggagaggagaccaggccatgctggagatgtcctgagtgctgcctcttgtgccccacagctgaagcagacgcctcccaaaactcctcatctatggtaaaccagcaatccggccctacgacggggtccctgacccgattcctctgggctccaagtctggcacctcacgtccctcctggtcatcgctgggcctcgaggctgacgatgngtctagtattattattgcctaagtccttatgaaccaacctaccttggttccgtttggtttcggcgttggttcgggcggacgggtaaccgaaggtccg

SEQ ID NO: 401354 - DNA, 576 bp, Homo sapiens
  misc_feature: GZ8MTXP01EOS58.21.25.C03.1.454.CMB.2.raw
  modified_base (264)..(264): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtccngagtgctgcctcttgtcgcccacagctagaagcagacgcctacccaaactcctacatctataggtaaccagacaagtccggccctacgacggggtccctggacccgtattctctcgggctaccaagtctggcacctcacgtccctcccgtggtcatcgcgtcgggcctccggacggtcgtagaccgtagtggacggtctagtaatttaattattcgcctaacgttccttatacgacctaaacctacccgttggttccgtttgggttttggcgttcgggtttccgggcgggttaccgggaaccgaaggtcccg

SEQ ID NO: 401355 - DNA, 586 bp, Homo sapiens
  misc_feature: GZ8MTXP01BRXTO.21.25.C03.1.454.CMB.2.raw
  modified_base (287)..(287): a, c, t, g, unknown or other
  modified_base (337)..(337): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccanagctgaagcaagacgccctacccaaaactcctacatctagtggtaaaccngacaagtccggccctcgacggggtccctagacccgtattcctctcggcctccaagtctcggccacctcacgtccctccctggtcatcgcgtcgggcctccggaggtcgtcgacgagtggagtctagtatttattagttcgcctaacgttccttatacgaacctaaaccgtacccttcggttccggtttgggtttttcggcgtttcgggtttccggggccgggttaccggggtaacccgaacggtcccgg

SEQ ID NO: 401356 - DNA, 606 bp, Homo sapiens
  misc_feature: GZ8MTXP01CWNOG.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagtattgtcctgagtgctgcctcttgtcgccccanagctagaagcagacgccctaccaaactcctacatctatacggtaaaccagacaacgtcccggcccctacggacgggggttccctaggtaacccgtatttccgtcgtcgggtcctacccgtaagttccgtcggcctacccttcacgtcccttcccgtggtccacgtccgtcgtcggggcctccggacggtcgtcggacgagtcggaggtcttagtatttattattcgcctaacgttccttagtacgacgtaaaccgtcccgttgttcggtttcggttttcggcgttcgggttcggcgggacggtaaccgaacgtccg

SEQ ID NO: 401357 - DNA, 667 bp, Homo sapiens
  misc_feature: GZ8MTXP01BR7Q8.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgctggagtattgtcctggagtgctgcctcttgtcgcccanagctagaagcagacgccctacccaaaacttcctacaattcctaagtacggtaaaccaggactaaacgtcccgggaccccttaacggaccgggggtcccctgggaaacccgtatttcccgtacgtcgggacccttaccgaacggttcctacgggccctacccgttccgaaccggtccccttcccgttgggtccctaacgttcccgccggttcggggtcccttcccgggaacggggtccgttacgggacggtaagtcggaacgggtcttaggtaatttatttagttcgacctaacggtccttagtacgaaccaaccgtacccgttggttcgtttgggttttcggcgttcggttcggggcgggccgggtaacgcggtccg

SEQ ID NO: 401358 - DNA, 787 bp, Homo sapiens
  misc_feature: GZ8MTXP01D2S4Y.21.25.C03.1.454.CMB.2.raw
  modified_base (215)..(215): a, c, t, g, unknown or other
  modified_base (224)..(224): a, c, t, g, unknown or other
  modified_base (270)..(270): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagngaggagagnggaggaggagaggacgacgaggcagtgcgtaggagtagttcgtcgnggagtcgtcgtcgtccttcgttcgccgaccccaagacgtcgtaaggaacgaccgaaggacccgtacccctaaacccctaaaacccttccctaacttaacttaccgtaaggtaacgtaaacccgacgaactaaccggtccccggtacccctaacgggggtaacccgggttccctacggaaacccgttactttcccgtcggtccgggtaccctaacccgtaacgtttccgacggtacccctaaccgttccgacccgttcccccttccggttcggtaacctacgtcccggtcggtcggggtaccctcggggaacggtccgtaacggaccgtagtcgggacgttacgttaagttaacttttaagtttacgttccggacccttaacggttaccctttaaggtaccgaaaaccctaaaccccgtttcccgttgggttttcggggtttttcgggttttccgggcgttttcgggggttcccgggggacggggttaaccccgggaacccgttaacgggttccccgg

SEQ ID NO: 401359 - DNA, 432 bp, Homo sapiens
  misc_feature: GZ8MTXP01A203V.21.25.C03.1.454.CMB.2.raw
  modified_base (324)..(324): a, c, t, g, unknown or other
  modified_base (409)..(409): a, c, t, g, unknown or other
  modified_base (419)..(419): a, c, t, g, unknown or other
  modified_base (425)..(432): a, c, t, g, unknown or other
tcagtcgtcgctcgcacgaccggtgctcgatttagtagtgtagatttgggtttggggctgccctttggttttggagatggttttctcgatgggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccatgccgtccacgtaccagttgaactggacactggtcaccgtctcttcagcctccaccaagggcccatccggtcttccccctggccnccctgctccaggagcacctccgagagcacagcggccccctgggctgcctggtacaaggctactcccgagcgacgactgagcgggntggcaaggcncatagnnnnnnnn

SEQ ID NO: 401360 - DNA, 693 bp, Homo sapiens
  misc_feature: GZ8MTXP01DXSUR.21.25.C03.1.454.CMB.2.raw
  modified_base (262)..(262): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagatgtcngagtgctgcctcttgtgccccaanagctagaagcaagacgaccctaccaaacctcctacactacgtaagtaacggtaaacccagactaaacgtcccggaccccgtaacggtaaccggggtccctacggtaacccgtactttccgtacgttacgggacctacccgtaaacgtccgtcggtaccctaacccgtaccgtaccgtaccccgtcccgttacggtacgtacgtccgtccgtcgggtaccgtaccgggtacggtacgtacggaacggtaacgtaggtacggtacgtagttaagtttaatttaacgttacgtaccgtaacgtaccgttaacgtacgaaaccgtaaacctaacccgttacggttcggtttcgggttttcggttcggttcggttcgggtccgggttaccgggtaaccggttaacgtaaccg

SEQ ID NO: 401361 - DNA, 630 bp, Homo sapiens
  misc_feature: GZ8MTXP01A5WZR.21.25.C03.1.454.CMB.2.raw
  modified_base (274)..(274): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagagttgtctgagtgctgcctnttgtcgcccangctagaacgcagacgccctaccaaactcctatactctagtacggtaaacccaggactaaagtcccggacccctacggaaccgggggtcccctaggtaaccccgtatttcctcgtcgggaccttaccgaaagttcctaggaccctaccgtccgacgtcccctcccgttgggtcctacgtccgtccggtcgggtccttccggacgggtcgtacgaccgagtcggaggtcctaggtaatttaggttacttcgccgtaacgtcccttatacgaactaaacctccccgttggttcgttttcgggttttcgcgttcggttccgggcggttacgggtaaccgttaagtccgg

SEQ ID NO: 401362 - DNA, 580 bp, Homo sapiens
  misc_feature: GZ8MTXP01DNXNC.21.25.C03.1.454.CMB.2.raw
  modified_base (285)..(285): a, c, t, g, unknown or other
  modified_base (479)..(479): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtgccccanagctgaagcaagacgccctacccaaactcctcacgtctagtaggtaaacccagacaaagtcccggccctaacggaacgggggttcccctaggacccgtatttccctcgtcgggtcctacccaagttctacggccacccttcacgtcccctcccgttcggtcacgtccgcgtcgggcctccggaggcgtgaccgntgagtctagtattattatcgctaagtccttatcgacaacctccgttgttcggtttgggttttggcgttcggttcgggcgggttcgggaaccgaaggtcccg

SEQ ID NO: 401363 - DNA, 579 bp, Homo sapiens
  misc_feature: GZ8MTXP01AGNQT.21.25.C03.1.454.CMB.2.raw
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgtagtgagcgaggagagtgaggaggagaggagaccaggccatgctggagattgtcctgagtgctgcctcttgtcgcccanagctgaagcagacgcctaccaaactcctcatctatggtaacacgcaagtccggccctcgaacggggtccctgacccgtattctcgtggctccaagtcctaggccacctcgacgccctcccgtggtcactcgcgtgggcctccgacggggtctggacgagtggaggtctagtatttattattcgtcctagttcctaattcgaaccaaccgtaccccgttggttccgggtttgggtttttcgggtccgttgggttccggggtccggggaccggggacccgaacggttccgttccgg

SEQ ID NO: 401364 - DNA, 678 bp, Homo sapiens
  misc_feature: GZ8MTXP01C9MWX.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctagaagcagacgccctaccaaaactcctacattcctatacggtaaacccaggacaaacgtcccgggccccttaacggaacgggggttcccctaggaccccgtatttcctcgtcgggtcctaccgaacgttccgtcgggacctacccttccaccggtccccttccccgtgggttccacgttccgccgtcggggtcccttccggacgggtccgttacggaccgtaagttggaacggtcgttaggtaattttatttaacgttcgacccgtaaggttcccttaagttaccgaaactaaacccgtacccgttgggttcccggttttgggttttttcgggccgtttcggggtttccggggtccggggaccggggtaacccgaaacggttcccgg

SEQ ID NO: 401365 - DNA, 603 bp, Homo sapiens
  misc_feature: GZ8MTXP01ARET3.21.25.C03.1.454.CMB.2.raw
  modified_base (255)..(255): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagnttgtctgagtgctgcctcttgtcgccccanagctgaagcagacgccctaccaaactcctcatctatggtaaaccagacaagtcccggccctacgacgggggttcccctaggaaccccgtatttcccgtcgtcgggcctacccaacgttccgtacggcctaacccgttccaacggtccccttcccgtggtccacgttccgcgtcggggcctccggagggtctgaccgagtcggaggtctagtatttagttattcgcctaacgtccttatcgaactaaacctacccgttggttcgtttgggttttcggcgttcgggttcgggcgggttaccgggaaccgttaacggtccg

SEQ ID NO: 401366 - DNA, 593 bp, Homo sapiens
  misc_feature: GZ8MTXP01BKNRQ.21.25.C03.1.454.CMB.2.raw
  modified_base (266)..(266): a, c, t, g, unknown or other
  modified_base (278)..(278): a, c, t, g, unknown or other
  modified_base (283)..(283): a, c, t, g, unknown or other
  modified_base (288)..(288): a, c, t, g, unknown or other
  modified_base (371)..(371): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtcgggcccaggaccctgtgcagtgagcgaggagagtggaggaggagaggagaccgaggccatgctggagattgtcngagtgctgcctnttgcncccangctgaagcagacgcctaccaaactccatatctatacggtaaaccagactaacgtccgccctagaccggggtcccagacccgtnttcctcgtcgtctacgtagtcgcggccaccgtcacgtccctccgtcgtcacgtccgtcgtcgggccttccgggacgggtccgtaggacgagtcggaggtctagtaatttgttagtcgactaacgtcttagtacaacctaaccgtaccgttggttccggtttgggttttcggccggtttcgggttccggggccgggttaccgggtaaccgttaacggtcccgg

SEQ ID NO: 401367 - DNA, 637 bp, Homo sapiens
  misc_feature: GZ8MTXP01B3MGS.21.25.C03.1.454.CMB.2.raw
  modified_base (314)..(314): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctggagattgtctgagtgctgcctcttgtcgcccacagctgaagcagacgcctaccaaactcctanatctatcggtaaaccaggacaagtccggccctacgaacggggtccctaggacccgtattcctcgtcgggcctaccaagttcgtcggaccaccctcgacgtcccttcccgtcggtaccacgttccgcgttcggggcccttaccggggacggtccgtaggaccgaagttcggaacggtcttaggtaactttaagtttagttccgtaccgtaacggttacccttagttaacggaccctaaacccgtacccgttcggttcggttttcgggtttttcggccgtttcgggttccggggcgggttaccgggtaacccgttaaggtcccgg

SEQ ID NO: 401368 - DNA, 586 bp, Homo sapiens
  misc_feature: GZ8MTXP01EKOHY.21.25.C03.1.454.CMB.2.raw
  modified_base (317)..(317): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtctgagtgctgcctctgtcgccccacagctgaagcagacgcctacccaaactcctanatctaatggtaaacccagcaagtccggcccctacggacgggggttcccctaggaacccgtatttccgtcgtgggccttaccaagtcctggccacctcacgtcccttcccgtggtcacgttccgcgtcgggcctaccggaggctacggacgtagtcggaggctagtattattacgttcggcctaagttccttatcgaacctaaacgtacccttggttccggtttggttttcggcttgggttcgggcgggttacgggaaccgttaagtccg

SEQ ID NO: 401369 - DNA, 542 bp, Homo sapiens
  misc_feature: GZ8MTXP01C1BHP.21.25.C03.1.454.CMB.2.raw
  modified_base (261)..(261): a, c, t, g, unknown or other
  modified_base (283)..(283): a, c, t, g, unknown or other
  modified_base (384)..(384): a, c, t, g, unknown or other
  modified_base (447)..(447): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagacaggccatgctggagatgtcngagtgctgcctcttgcgcccanagctgaagcaagacgccctaccaaaactcctacaatctaaatcggtaaaccagcaaactcccgggaccctacggaacggggttccctagacccgtatttcncgtggcctaccaagtctggcacctcacgccctcctggtcactcgcgtcgggctccggaggtcngacgatgagcgtgtattattattgcaactcttatacacgaactaaccttcgttcgttggtttggtcgtcgtcggtcggcggtaacgaacgtaacg

SEQ ID NO: 401370 - DNA, 634 bp, Homo sapiens
  misc_feature: GZ8MTXP01BM8EW.21.25.C03.1.454.CMB.2.raw
  modified_base (287)..(287): a, c, t, g, unknown or other
  modified_base (297)..(297): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctggagtgctgcctcttgcgccccanagctaggaancagacgccctacccaaactcctacatctaagtacggtaaacccagacaacgtcccggcccctaacggacgggggtcccctggaccccgtatttcccgtcgtcgggccttacccgaacgttccgtcggcccaccctccacgtccccttcccgttggtccacgtccgcgtcgggcctccggacggtcgtcggacgtagtggaggtctagtatttattacgttcgcccgtaacgtccttatacgaacctaaaccgtacccgttggttcggtttcgggtttttcggccggtttcggggttaccggggccggggttaccgggtaacccgttaacggtcccgg

SEQ ID NO: 401371 - DNA, 681 bp, Homo sapiens
  misc_feature: GZ8MTXP01EGQ3Z.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgctggagattgtctgagtgctgcctcttgtcgcccangctgaagcagacgcctacccaaactcctacattctaagtcgtaaaccagacaagtccggccctacgacggggtccctgacccgtattctcgtcggcctaccgtaacgtcgtcggcctacctcacggtccccttcccgttcggtcctacgtccgtccgtcggggtacccgttccgggacgggtccgttacgggaaccgtaagttcgggaacggttcgttaggtttaactttagttaacgtttccggtaccctaacggtttacccttaacgtaaccggttaaaccctaaacccgttaacccgttcgggtttcccgggttttggggttttttccgggccggtttcggggtttccgggggcccggggttaccgggggtaacccgttaacgggttcccgg

SEQ ID NO: 401372 - DNA, 622 bp, Homo sapiens
  misc_feature: GZ8MTXP01AP38F.21.25.C03.1.454.CMB.2.raw
  modified_base (263)..(263): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctgggccccagacaccgagggcggctgcgtcagcacagactgggcccaggaccctgtgcagtgagcgaggagagtgaggaggagaggagaccaggccatgctggagtattgtccngagtgctgcctcttgtcgcccacagctagaagcgagacgccctaccaaactcctacatctagtacggtaaaccagacaacgtcccggccctacggacggggttccctaggacccgtactttctcgtcgggcctaccgtaagtcgtcggcctacccgtcacgtccccttccgtcggtccacgtccgcgtcgggtccctccgggaggtccgtagacgtagtggacggtcttagtatttagttacgttcgacctaacgttccttagtacgaacctaaccgtacccgttggttcgggttttgggttttcgggtcgtttcggggttccggggccgggttaccgggtaaccgttaacggtcccgg

SEQ ID NO: 401373 - DNA, 603 bp, Homo sapiens
  misc_feature: GZ8MTXP01B8QTG.21.25.C03.1.454.CMB.2.raw
  modified_base (495)..(495): a, c, t, g, unknown or other
  modified_base (506)..(506): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagacgtcgggcccaggaccctgtgcagtgagcgaggagagtgaggaggagaggagacaggccatgcgtggagtattgtcctgagtgctgccttcttgcgcccacagctagaagcaagacgccctaaccaaactcctacattactatacggtaaaccaggacaagtcccggccctaaggaaccggggttcccaggaacccgtactttccgtcgttcgggacctacccgtaagtcgtcggacctacctccacgtccccttcccgtcgttcacgtcgcgtcgggcctccggaggtctcgacgagtgacggtntagtattattntctctaacttcttatacgaacctaaccgtccttggttcggtttgggttttcggtcgttcgggttccggggcgggttaccgggtaaccgaacggtccg

SEQ ID NO: 401374 - DNA, 576 bp, Homo sapiens
  misc_feature: GZ8MTXP01CUESW.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctctgtgccccanagctgaagcaagacgcctaccaaactcctacatctataggtaaaccagacaatccggccctacgacggggtcccctggacccgtattcctcgtcgggcctaccaagttctcggccacctccacgcccttcccgtggtcactcgcgtcgggcctccggacggcgtagacgagtgaggtctagtattattagtcgcctaagtccttatcgacctaaacctacccgttggttcgtttcgggtttttggcgtttcgggttccgggcgggttaccgggtaaccgttaacggtccgg

SEQ ID NO: 401375 - DNA, 640 bp, Homo sapiens
  misc_feature: GZ8MTXP01CMAK8.21.25.C03.1.454.CMB.2.raw
  modified_base (288)..(288): a, c, t, g, unknown or other
  modified_base (388)..(388): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgccttcttgtcgccccanagctagaagcagacgccctaccaaactcctacatctagtacggtaaccagacaacgtccggcccctaacggaccggggtccctggtaacccgtatttccncgtcgggcctaccgtaacgtcgtacggccaccctcgaccgtcccttccccgttcggtcctacgtccgtcgtcgggccttccggacggtcgtagaaccgagtcggacggtcgtagtatttaattacgttcgacctaacgttacccttatacgaacctaaacccgtacccgttcggttcggtttcgggtttttcgggccgttttcggggttccggggtccgggggttaccgggtaacccgttaacggttcccgg

SEQ ID NO: 401376 - DNA, 607 bp, Homo sapiens
  misc_feature: GZ8MTXP01APA4Z.21.25.C03.1.454.CMB.2.raw
  modified_base (261)..(261): a, c, t, g, unknown or other
  modified_base (273)..(273): a, c, t, g, unknown or other
  modified_base (278)..(278): a, c, t, g, unknown or other
  modified_base (283)..(283): a, c, t, g, unknown or other
  modified_base (297)..(297): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgtcngagtgctgcctntgtcncccanagctgaagcagacncctaccaaactcctacatctagtacggtaaaccacggactaacgtccggccctaacggaccggggtccctagtacccgtattccgtcgtcggtcctaccgacgtctacggccaccgtcacgtccctccgtggtccacgtccgcgtcgggtcctcccgggaggtccgttaggaaccgtagtcggacggtccttaggtaactttagttacgtcgacccgtaagttaccttagtaccgaaacctaacccgtccgttggttccggtttggtttcgcgttcgggtaccggcgggttaccggtaacgaacgtccgg

SEQ ID NO: 401377 - DNA, 622 bp, Homo sapiens
  misc_feature: GZ8MTXP01EFV37.21.25.C03.1.454.CMB.2.raw
  modified_base (294)..(294): a, c, t, g, unknown or other
  modified_base (302)..(302): a, c, t, g, unknown or other
  modified_base (308)..(308): a, c, t, g, unknown or other
  modified_base (343)..(343): a, c, t, g, unknown or other
  modified_base (382)..(382): a, c, t, g, unknown or other
  modified_base (432)..(432): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtgaggaggagaggagaccaggccagtgcgtggagtattgtcctggagtgctgcctgttgtcgcccangctagaancagacnccctaccaaactcctacattctaatcggtaaaccngacaacgtcccgccctacggacggggtccctagaccctnttcctcgtcggcctacagtcgtacgccacctcacgtccctccgtggtccncgtccgcgtcgggcctacgggacggtctacggacgagtggacggtcttagttatttagttacgttcgcctaacgttcccttaaagtacgaaaccctaaaccgtcccggtttcggttcgggttttcgggtttttcgggccgtttcggggttccggggaccgggttaccggggtaacccgaacggttcccgg

SEQ ID NO: 401378 - DNA, 520 bp, Homo sapiens
  misc_feature: GZ8MTXP01B9ACF.21.25.C03.1.454.CMB.2.raw
  modified_base (476)..(476): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccacagctgaagcagacgcctaccaaactcctcatctatcggtaaccagcaagtccggccctacgacgggggtccctgacccgtattctctggctaccaagtctggcacctcacgccctccctggtcacgtcgcgtcgggctccgaggctgacgatgagctagtattattattgctaagtccttatcgacaacnccttgttcgttggttttggcttgttcggcggcggtcgaagtccg

SEQ ID NO: 401379 - DNA, 576 bp, Homo sapiens
  misc_feature: GZ8MTXP01BL11S.21.25.C03.1.454.CMB.2.raw
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgggcagtgctggagattgctgagtgctgcctcttgtcgcccanagctgaagcagacgcctaccaaactcctcatctatggtaacacgcaagtccggaccctcgaacggggtccctggaccctattcctcgtcggctaccaagtctggccacctcacgtccctcccgtcggtctacgttccggcgtcgggccttccgaggggtcgtaggaccgtagtcggcggtcgttagtatttacttagttcgacctagtcctaagttcgaaccaacgtacccctggttccggtttggttttcggcttggtcgggcgggacgggacctaacggttcgtaaccgg

SEQ ID NO: 401380 - DNA, 529 bp, Homo sapiens
  misc_feature: GZ8MTXP01AI33V.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagacgcctaccaaactcctcatctatggtaaccagcaatccggccctacgacggggtccctgacccgtattcctcgtggctaccgaagtctcggcacctcacgccctccctggtccacgtcgctgggcctccgaggctgacgatgagctgattatatcgctaagtcttatcgacaactacccttgttcgttggttttggcgttcggttcgggcggttcgggaaccgaagtccg

SEQ ID NO: 401381 - DNA, 551 bp, Homo sapiens
  misc_feature: GZ8MTXP01EIXCG.21.25.C03.1.454.CMB.2.raw
  modified_base (287)..(287): a, c, t, g, unknown or other
  modified_base (425)..(425): a, c, t, g, unknown or other
  modified_base (459)..(459): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtctgagtgctgcctcttgtcgcccaanagctagaacgcaagacgccctacccaaaactcctacatctaagtcggtaaaccaggacaaagtccggccctacgacggggtccctgaccgtattcctcgtcggctacaagtcgtggcacctcacgtccctcctggtcntcgcgtcgggctccgaggctagacgagtgacgtntagtattattattcgctaatccttatcgaacaactacccttgttcggttggttttcggcgttggttcgggacggcgggaacccttaagtccg

SEQ ID NO: 401382 - DNA, 662 bp, Homo sapiens
  misc_feature: GZ8MTXP01D62FP.21.25.C03.1.454.CMB.2.raw
  modified_base (346)..(346): a, c, t, g, unknown or other
  modified_base (389)..(389): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggcgaccgtctgccctggggccccagacaccgagggcggctgcgtcagcacagactgggcccaggaccctgtgcagtgagcgaggagagtgaggaggagaggagaccaggccatgcgtggagattgtcctgagtgctgccttcttgtcgccccagagctagaacgcaagacgtccctacccaaaactcctacattctaagtacggtaaaccnggacaacgtcccggccctacgacggggtccctgaccgtattcncgtggcctacagtctggccacctcacgtcccctccgtggtctacgtccgcgtcgggcccttccgggaacgggtcgttacggaacgtaagtcgggaacggttcgttacggttaatttaacgtttagttccggtaccctaacggtttaccttaaacgttacggaaaccctaaaacccgtccccgttgggtttccggttttggggtttttccggtcggtttcggggtttcccgggggaccggggttccggggtaaacccgttaacgggttccccgg

SEQ ID NO: 401383 - DNA, 586 bp, Homo sapiens
  misc_feature: GZ8MTXP01BJIA3.21.25.C03.1.454.CMB.2.raw
  modified_base (286)..(286): a, c, t, g, unknown or other
  modified_base (334)..(334): a, c, t, g, unknown or other
  modified_base (363)..(363): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagccagacgcctacccaaaactcctacatctatggtaaaccngacaatccggccctcgaacggggttcccngacccgtattcctcgtacggcctaccaagtctcggccacctccacgtccctccctggtccacgttccgcgttcgggcctccggacggtctcgaccgagtgacggtctagtattacgttattcgcctaagtcccttagtacgttaacctaaccgacccgttggttccgtttgggttttcgcgttcggttcggggccggttaccggggaaccgttaaggtcccgg

SEQ ID NO: 401384 - DNA, 507 bp, Homo sapiens
  misc_feature: GZ8MTXP01BVFP2.21.25.C03.1.454.CMB.2.raw
  modified_base (285)..(285): a, c, t, g, unknown or other
  modified_base (327)..(327): a, c, t, g, unknown or other
  modified_base (366)..(366): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtgccccanagctgaagcagagcctccaaactcctcatctatggtaaaccngcaagtccggccctcgagggggtcccctgacccgattcnctaggctccaagtctggcacctcacgccctccctggtcatcgctgggctccgaggctgaccgatgaggctgattatattcgcaagtccatgacaacgacccttgcgttggttttgctgttcggcggcgggtaacaagtccg

SEQ ID NO: 401385 - DNA, 763 bp, Homo sapiens
  misc_feature: GZ8MTXP01B2VX8.21.25.C03.1.454.CMB.2.raw
  modified_base (269)..(269): a, c, t, g, unknown or other
  modified_base (295)..(295): a, c, t, g, unknown or other
  modified_base (354)..(354): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaggagagtgagggaggagaggacgaccaggccatgcgtggagtattgtccngagtgctgccttcttgtcgccccacngctagaacgcagacgccctacccaaacctcctacaattcctaaagtacgggtaaacccncggactaacgtcccgggaccccttacgggaacccgggggttccctacggacccgttattttcccgtacgtcggggtacccttacccgtaaacggttccgtaccgggtaccctaacccgtcccgtaccggtcccccctttcccggttcgggttcccacgttcccgggccggttcgggggtaccccttccgggaacggggtccttacgggaaccggtagtacgggtaacgggtctttaggttaattttaagtttactttccggaccctaacggtttacccttacgttacggttaaacccgtaaaccccgttcccgtttcggttcggggttttttcgggtttttccggggcggtttccggggtttcccgggggccgggggttacccgggtaacccgttaaacggttcccggg

SEQ ID NO: 401386 - DNA, 639 bp, Homo sapiens
  misc_feature: GZ8MTXP01DL3X0.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggacgaccgaggccagtgcgtggagtattgtcctgagtgctgccttcttgcgcccagagctagaacgcaagacgccctaccaaactcctactatctagtacggtaaaccacgacaacgtcccggaccctacggaacggggttcccacggtacccgtactttcctcgtcgggtaccttaccgtaacgttccgtacggccctaacccgtccgaccgtccccgttcccgttacggtccacgttccgcggtcgggtccctacgggacggtcgtagacgagtcggacggtcgttagtatttagttacgtcgtccgtaagttccttagtacgaacctaaaccgtcccgttggttcggttttggttttcggtcgttcgggttcgggcgggacggtaaccgaacggttccg

SEQ ID NO: 401387 - DNA, 514 bp, Homo sapiens
  misc_feature: GZ8MTXP01D6MTL.21.25.C03.1.454.CMB.2.raw
  modified_base (288)..(288): a, c, t, g, unknown or other
  modified_base (450)..(450): a, c, t, g, unknown or other
  modified_base (475)..(475): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggcccccagacaccgagggcggctgcgtcagcacagactgggcccaggaccctgtgcagtgagcgaggagagtgaggaggagaggagaccaggccatgctggagattgtcctgagtgctgcctcttgtgccccanagctgaagcagagcctccaaaactcctcatctaatggtaaacccaggacaaatccgggcccctcgacggggtccctgacccgtattcctcgtggcctaccaagtctggcacctcacgccctccctggcatcgctgggctccgaggctgacgatgaggctagnttatattgccaagtccatgacaacncccttgcgttggtttgctgttcggcgcgggaacaagtcg

SEQ ID NO: 401388 - DNA, 716 bp, Homo sapiens
  misc_feature: GZ8MTXP01CYIZ3.21.25.C03.1.454.CMB.2.raw
  modified_base (265)..(265): a, c, t, g, unknown or other
  modified_base (290)..(290): a, c, t, g, unknown or other
  modified_base (347)..(347): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtgggcccaggaccctgtgcagtgagcgaggagagtgaggaggagaggagaccaggccatgcgtggagtattgtcngagtgctgccttcttgtcgccccanagctaggaacgcaagacgcccctaacctaaacctcctacatctaagtcggtaaaccnggacaacgtcccgggccccttaacgggaaccggggtcccctaggtaacccgtatttccccgtcgttcgggacctacccgtaacgtccgtcggaccctacccgtccaccgtccccttccccgtcggtaccacgtccgtcgtcgggtccctacggggacggtcgtacggaaccgtagtacggtacgggtctaggttaacgtttattaacgttcgtacccgtaacggttacccttaacgttaaccggaaacccttaaacccggtaacccgtttcgggttccggggttttcgggtttttttccggggcgtttcggggtttacccgggggcccggggttaaccgggggtaaccccgttaaacggggttccccgg

SEQ ID NO: 401389 - DNA, 531 bp, Homo sapiens
  misc_feature: GZ8MTXP01D295B.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtcctgagtgctgcctcttgtcgcccanagctgaagcagagccctaccaaaactcctacatctataggtaaaccagcaaagtccggccctacgacggggtccctgacccgtatttctctggctaccagtctcggcacctcacgtcccttcccgtggtcagtcgctcgggcctccgacggctcgacgatcgaggctagtattattatcgctaagtccttatcgacaactaccttgttcgttggtttgctggttcggcggcggtaacgaagtcg

SEQ ID NO: 401390 - DNA, 714 bp, Homo sapiens
  misc_feature: GZ8MTXP01EERVZ.21.25.C03.1.454.CMB.2.raw
  modified_base (262)..(262): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgcgtggagattgtcngagtgctgcctcttgtcgcccacngctgaagcagacgcctacccaaactcctacactactatacggtaaaccagacaacgtccggacccctaacggacggggttccctggaacccgtactttcctcgttcgggccttacccgtaacgttcctacggccctaccgtcgacgtccccttcccgtggtccacgttccgcgttcggggccttaccggggaggccgttaggaccgtagttacggacggtcgttaggttactttaagtttacgttaccggcccttaacgggttaccccttaaagttaccggttaaacccgtaaacccgttaaccccggtttcggggtttcccggggtttttcggggtttttttcgggggtcccggttttaaccgggggttttcccgggggacccgggggttacccgggggtaaccccgttaaacgggtttccccgggg

SEQ ID NO: 401391 - DNA, 557 bp, Homo sapiens
  misc_feature: GZ8MTXP01CHMZS.21.25.C03.1.454.CMB.2.raw
  modified_base (288)..(288): a, c, t, g, unknown or other
  modified_base (322)..(322): a, c, t, g, unknown or other
  modified_base (340)..(340): a, c, t, g, unknown or other
  modified_base (380)..(380): a, c, t, g, unknown or other
  modified_base (430)..(430): a, c, t, g, unknown or other
  modified_base (464)..(464): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggccccaggaccctgtgcagtgagcgaggagagtgaggaggagaggagaccaggccatgctggagattgtcctgagtgctgcctcttgcgcccanagctagaagctagacgccctaccaaactccgtanatctaagtcggtaaaccngcaacgtccggcccctaacgacggggtccctgaacccgtntttcctcgcggtctacctaagtctcggcacctcacgcccttcccgtgtcngtcgcgtgggcctcggagcctgacagtgacggtntatattattacgtcgctaactcttatacaccgtaccgtcgttggttcggtttcggtttcggcgttcgggtccgggcggacggtaacgcggtcg

SEQ ID NO: 401392 - DNA, 582 bp, Homo sapiens
  misc_feature: GZ8MTXP01ATAWJ.21.25.C03.1.454.CMB.2.raw
  modified_base (265)..(265): a, c, t, g, unknown or other
  modified_base (288)..(288): a, c, t, g, unknown or other
  modified_base (556)..(556): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagagggagaccgaggccatgctggagattgtccngagtgctgcctcttgtcgcccanagctgaagcagacgccctaccaaactcctacatctaagtcggtaaaccagacaaacgtcccggccccttacggaaccgggggttcccctaggacccgtatttcccgtcgtcgggccttacccgaacgttcttcgggcccacccttcacgtcccctcccgtcggtcacgtcgctcggggcctccggaggctggacgagtggaggtctagtattagttacttcgacctgtccttatacaccactacccgttgttcggtttggttttcggntcggttcggcggcggtaacaagtccg

SEQ ID NO: 401393 - DNA, 605 bp, Homo sapiens
  misc_feature: GZ8MTXP01AF6L5.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcctgagtgctgcctcttgtgccccacagctgaagcagacgcctccaaactcctcatctatggtaaccagcaagtcccggccctacgacggggtccctgacccgtattcctcgtcgggccttacccaagtctgggccacctcacgccctacccgtggtccacgttccgacgtcggggcccttccggacggtcgttcggacgtagtcggaggtccgttaggtaatttgtttaagtttcgccctaacggtcccttagtacgaaccgtaaacctaccccgttcggttcggtttgggttttttcggcgtttcggtttccgggcggttaccgtaacgaacccgtaaccgg

SEQ ID NO: 401394 - DNA, 563 bp, Homo sapiens
  misc_feature: GZ8MTXP01BP0IQ.21.25.C03.1.454.CMB.2.raw
  modified_base (284)..(284): a, c, t, g, unknown or other
  modified_base (330)..(330): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtgcccanagctgaagcagacgcctaccaaactcctacatctagtggtaaaccngacaagtcccggccctacgacggggtccctagacccgtattcctcgtcgggcctaccaagtctggccacctcacgtccctcccgtggtcacgttcgctcggggtcctccgggaggcgtagacgtagtggaggtctaggtatttattacttcgcctaagttcccttatacgacaaaccgtcccttggttccgttggtttcgcgttggttcgggcgggacggtaacgaacgtccg

SEQ ID NO: 401395 - DNA, 562 bp, Homo sapiens
  misc_feature: GZ8MTXP01D5Y3Y.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgggagattgtcctgagtgctgcctcttgtcgcccacagctagaagcaagacgccctacccaaaactcctacactctatcggtaaaccagacaagtccgccctcgacgggtccctgacccgattctactgggcctaccaagtcctggccacctcacgccctcccgtgtcactccgctcgggcctccggaggtctgaccgtagtgaggtcttaggaatttattattcggcctaaggtccttatagaaccaaccgtaccgttggttcgttgggttttgcgttggttcgggccggacgggtaaccgaaggtcccg

SEQ ID NO: 401396 - DNA, 883 bp, Homo sapiens
  misc_feature: GZ8MTXP01DAD8D.21.25.C03.1.454.CMB.2.raw
  modified_base (282)..(282): a, c, t, g, unknown or other
  modified_base (288)..(288): a, c, t, g, unknown or other
  modified_base (294)..(294): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactcgggcccaggaccctgtgcagtgagcgaggagagtgaggaggagaggagaccgaggccatgcgtggagtattgtcctgagtgctgcccttnttgtcnccccanagctagaagcaagacgcccctaaccaaacctcctacacttctaagtacggtaaaccccaggacctaaacgtccccggacccccgttaaccgggtaacccggggggtttccccctaggtaaaccccggttacttttcccgtacccgttacggggtacccttacccgtaaacggttcccgttaccgggacccctaaccccgttacccgtaacccggtcccccgtttacccccgtttaccggggttcccgtaaccggttccccgggtaccggttacccgggggtaccccgttccccggggtaaacgggggtcccgtttaacgggaaacccgggtaacggttacggggtaacgggtaccgtttaaacgggtttaacttttaaagtttttaacgttcccggttacccgttaaccggtttaaccccttaaacgtttaaacccggaaacccttaaaaccccggttaacccccggttttagggtttcccgggggtttttaggggtttttttccggggtaccggtttttccggggggtttcccgggggtacccgggggttacccgggggtaaaccccggttaacgggttaaccccggg

SEQ ID NO: 401397 - DNA, 545 bp, Homo sapiens
  misc_feature: GZ8MTXP01BM5ZN.21.25.C03.1.454.CMB.2.raw
  modified_base (317)..(317): a, c, t, g, unknown or other
  modified_base (521)..(521): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccacagctgaagcagacgcctaccaaactcctnatctaatcggtaaccagacaagtccgcccctaacgacggggtccctgaccgtattcctcgtggcctaccaagtcgtcggccacctcacgtcccctccctggtcagttccgcgttcgggccttccggaggtcctaggacgatggaggtctgtatttattattcgccaagtccttatcgaacacctaccttgttcgttggtttcgngttgtcggcgcggtaacgaagtcg

SEQ ID NO: 401398 - DNA, 576 bp, Homo sapiens
  misc_feature: GZ8MTXP01DPOEF.21.25.C03.1.454.CMB.2.raw
  modified_base (543)..(543): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactcgggcccaggaccctgtgcagtgagcgaggagagtgaggaggagaggagaccaggccatgctggagattgtcctgagtgctgcctcttgtgccccacagctgaagcaagacgccctacccaaaaccttcctacacttcctatacggtaaaccaggcaaacgtccggcccctacgacgggggtcccctgaacccgtattcctcgtcggcttaccaagttcgtcggccacctcacgtccctcccgtggtcacgtcgcgtcgggcctcggacggtctagacgatggagctagtatttagttattcgcctaagtcttatcgaactaaacctcccgttggttcgttcgggttttcgngttcggttcgggcggttcgggaacgaacgtccg

SEQ ID NO: 401399 - DNA, 633 bp, Homo sapiens
  misc_feature: GZ8MTXP01DV21N.21.25.C03.1.454.CMB.2.raw
  modified_base (263)..(263): a, c, t, g, unknown or other
  modified_base (286)..(286): a, c, t, g, unknown or other
  modified_base (391)..(391): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccatgctggagattgtcngagtgctgcctcttgtcgcccanagctagaagcagacgccctaccaaactcctcaatctatacggtaaaccagacaaacgtccggaccctaccggacgggggttcccctacgtaacccgtatttcccncgtcgggcctacccaacgtcctcggcctacctccgacgtccccgttcccctggtccacgtccgtcgttcgggcccgttaccgggacggtcgttcgaaccgagttcggaacggtcttaggtaacttttattaacgttcgcctaacgtccttagttacgaaacctaaaccgtacccgttggttccggtttcgggttttggcgttcgggttccggggacgggttacgggaacccttaaggtcccg

SEQ ID NO: 401400 - DNA, 648 bp, Homo sapiens
  misc_feature: GZ8MTXP01AU63C.21.25.C03.1.454.CMB.2.raw
  modified_base (267)..(267): a, c, t, g, unknown or other
  modified_base (280)..(280): a, c, t, g, unknown or other
  modified_base (285)..(285): a, c, t, g, unknown or other
  modified_base (290)..(290): a, c, t, g, unknown or other
  modified_base (299)..(299): a, c, t, g, unknown or other
  modified_base (324)..(324): a, c, t, g, unknown or other
  modified_base (343)..(343): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtcgggcccaggaccctgtgcagtgagcgaggagagtgaggaggagaggagacaggccagtgcgtggagtattgtcngagtgctgccttntgtcncccangctaggaancaagacgtccctaccaaactcctanactctaagtacgtaaaccngacaagtcccggaccctacgacggggtccctaggaccgtattctcgtcgctaccgagtctcggccaccgttccacgtccctccgtggtccacgtccgacgtcggacctcgggacggtccgtaggaccggtagtcgggtacggtcttaggttaactttaacgttaacgttcggtaccctaacggttaccttaacggtaccgttaaacccgtaaaccgttccccgttgggtttccgggttttcgggtttttcggcggttttaacgggttcccgggcggggttaccgggtaaccgttaacggtcccgg

SEQ ID NO: 401401 - DNA, 676 bp, Homo sapiens
  misc_feature: GZ8MTXP01B6JKA.21.25.C03.1.454.CMB.2.raw
  modified_base (291)..(291): a, c, t, g, unknown or other
  modified_base (322)..(322): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtggagtattgtcctgagtgctgccttcttgtcgcccanagctagaagcagacgcctaccaaactcctanatctagtacggtaaaccagacaacgtcccggccctacggacggggtccctaggaacccgtattccgtcgtcggtccctaccgtaacgttccgtacggcctaccgttccgaccggtccccttcccgtggtccacgtccggtcgtcggggtcccttaccggggacggtcgttacggaaccggtagtgggtacgggtacttaggttaaactttactttacgttcggtaccctaacggttacccttaagttaccggaaaccctaaccgtaccccgtttggttccgggttttgggttttcgggcgtttaacggggttcccggggaccggggttaccggggtaaccgaacgggttcccgg

SEQ ID NO: 401402 - DNA, 744 bp, Homo sapiens
  misc_feature: GZ8MTXP01EQ40K.21.25.C03.1.454.CMB.2.raw
  modified_base (272)..(272): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtcgggcccaggaccctgtgcagtgagcgaggagagtgaggaggagaggacgaccgaggccagtgcgtggaagtattcgtcngagtgctgccttcgttgcgccccaagagctaggaacgcaagaccgtacccctaccaaaacttcctacaacttacctaagtacggtaaaccacggtacaacgtcccggccccttaacgggaaccggggttcccacggtacccgttactttccgtcgtcgggtcctaccgtaacgtcgtcggaccctacccgttccgaccggtccccttcccgttcggtacctacgtcccgtcgttccggggtcccttacccggggaacgggtccgtaacgggaccggtaagttcgggaaccggtttacgttaagttaactttacgttacgttccgtaacccgttaacgttaccgttaacgtaaccgttaaacccgtaacccgttcccggtttcgggtttccgggttttcggggttttcgggtccgggtttccggggttcccggggaccggggttacccgggtaacccgttaaccgggtcccgg

SEQ ID NO: 401403 - DNA, 600 bp, Homo sapiens
  misc_feature: GZ8MTXP01E370I.21.25.C03.1.454.CMB.2.raw
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtctggagtgctgccttcttgtgccccanagctgaagcagacgcctaccaaactcctacatctaagtggtaacccagcaaagtcccggccctacgacggggtccctagaccgtattctcgtggcctaccaagtcgtcggccacctcacgtccctcccgtggtccacgtcgtcgtcgggccttccggaggtctcgacgagtggacggtcttagtaatttattaacttcgccgtaacttcgttattaccgaaacctaaccgtaccccgttggttccggtttgggttttttcgggccgtttgggttcccggggtcgggaccgggtaaccgttaacggttcccgg

SEQ ID NO: 401404 - DNA, 593 bp, Homo sapiens
  misc_feature: GZ8MTXP01C7FL7.21.25.C03.1.454.CMB.2.raw
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccanagctagaacgcagacgccctacccaaaactccctacattctaagtacggtaaacccagacaagtcccggcccctacggacggggtccctgaacccgtattcgcgtcggcctacaacgtctcggccacctcacgcccttcccgtggtcacgtcgcgtcgggtcctccggacgggtccgtagacgtatgacggtcttagtatttattagtcgccctaagtcccttagtcgacctaaacctccgttcgttcggttttcgggttttcggcgttcggttccgggcgggaccgggtaaccgaacggtcccg

SEQ ID NO: 401405 - DNA, 580 bp, Homo sapiens
  misc_feature: GZ8MTXP01DTQR8.21.25.C03.1.454.CMB.2.raw
  modified_base (289)..(289): a, c, t, g, unknown or other
  modified_base (321)..(321): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtcctgagtgctgcctcttgtcgccccacngctagaagcagacgccctacccaaaactcctnattctaagtacggtaaaccaggacaacgtcccggcccctacgacgggggttcccctggaaccccgtatttcctccgtcgggccttacccaagttctacggccacctcacgcccttcccgtggtcatccgctgggcctcggaggcgtgacgagtgagtctagtatttattattcgcctaagtccttatcgaacgaacctcccttggttcgtttgggttttcggcgttcggttcgggcggttaccgggtaacgaaggtccg

SEQ ID NO: 401406 - DNA, 396 bp, Homo sapiens
  misc_feature: GZ8MTXP01CFNZC.21.25.C03.1.454.CMB.2.raw
  modified_base (359)..(359): a, c, t, g, unknown or other
  modified_base (385)..(385): a, c, t, g, unknown or other
  modified_base (391)..(396): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcggacagctgacgtcaggtcagccagctcgcccctggtccactctcgtcccgccctcctccgngcacgactgagcgggctggcaaggcncatagnnnnnn

SEQ ID NO: 401407 - DNA, 606 bp, Homo sapiens
  misc_feature: GZ8MTXP01BZNTH.21.25.C03.1.454.CMB.2.raw
  modified_base (268)..(268): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtggaggaggagaggagaccgaggccatgcgtggagtattgtccngagtgctgccttcttgtcgccccacagctagaagcaagacgccctaccaaaacttcctacattctaagtcggtaaacccaggacaacgttcccggccctacggacggggtccctagaacccgtattcctcgtcgggctaccaacgttctcggccacctcacgtccctcccgtgtcattccgctcggcctcgaggtctagacgtagtgaggtcttagtatttacgtatttcggcctaagttccttagtacgacctaaaccgtcccgttcggttcgtttgggttttcggtcgttcggggtttcccgggcgggttaccgggggaacccttaacgggtcccg

SEQ ID NO: 401408 - DNA, 607 bp, Homo sapiens
  misc_feature: GZ8MTXP01DSA13.21.25.C03.1.454.CMB.2.raw
  modified_base (264)..(264): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactcggggcccaggaccctgtgcagtgagcgaggagagtgaggaggagaggagacaggccatgcgtggagattgtcngagtgctgcctcttgtcgccccanagctagaaagcaagacgaccctaccaaaactcctacaatctaagtcggtaaaccagacaagtccggcccctacgacggggttccctgaacccgtattcctcgtgggcctaccaagtctcggcctacctcacgtccctcccgtggtcacgttcgcgtcgggcctccggacggtcgtagacgtagtggagctagtatttattattcgctaacgtccttattacgaaccgtaaacctaccgttaggttccggtttgggttttttcggtcgtttcgggtttccggggaccgggttaccggggtaacccgttaacggttaaccg

SEQ ID NO: 401409 - DNA, 697 bp, Homo sapiens
  misc_feature: GZ8MTXP01AV5YI.21.25.C03.1.454.CMB.2.raw
  modified_base (263)..(263): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtccngagtgctgcctcttgtcgccccanagctagaagcaagacgcccctaccaaacttcctacattctagtacggtaaaccagacaacgtcccggccctacggaccggggtccctaggtacccgtatttccgtcgtcgggcccttaccgtaacgtccgtacggaccctacccgttccgaccgttccccgttccccgttgggtaccctacgttcccggtccgttcgggggtccccttccggggaacgggtccgttacggaaccggtagttacgggacggtacttaggtaattttacgtttagttccgacccgttaagttcccttaagtacgttaaccgaacccgttacccgttcgggtttcgggttttcgggtttttcgggtcgtttcggggtttcccggggtaccggggttaccggggaacccgttaacggtccccgg

SEQ ID NO: 401410 - DNA, 656 bp, Homo sapiens
  misc_feature: GZ8MTXP01CV3RQ.21.25.C03.1.454.CMB.2.raw
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctctgtcgcccanagctgaagcaagacgcctaccaaaactcctacactactatacggtaaaccacggacaaagtcccgggaccccttacggaaccgggggttcccctagggtaaccccgttatttccgtaccgtcgggtacctacccctaaaggttccgtacgggcccaacccttccgaaccggtccccttccccgttgggtaccacgttccgcgtggggtccctaccgggaacggtccgttagaccgtagtggaaggtctaggtatttagttagtcgtccgtaacttcccttagtacgaaacccgtaaacctccccgttggttccggtttgggtttttcggcgttcgggttccggggcgggaccgggtaacccgaaggtcccgg

SEQ ID NO: 401411 - DNA, 575 bp, Homo sapiens
  misc_feature: GZ8MTXP01EKS77.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccanagctagaagcagacgcctacccaaactcctcaatctataggtaaaccagcaaagtccggccctacgacggggtccctgacccgtattccgtcgtggccttaccaagtctcggccacctcacgtccctcccgtggtcagttccgcgtacgggcctcggaggtctcgaacgatgaggtctagtatttattacgttcgcctaagtcccttaaatacgttaaaccgtaaccgtccgttggttcggtttggtttcggtcgttcggtcgggcgggaccggtaaccgttaacgtccg

SEQ ID NO: 401412 - DNA, 787 bp, Homo sapiens
  misc_feature: GZ8MTXP01EUAM4.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtcgggcccaggaccctgtgcagtgagcgaggagagtgaggaggagaggagacaggccatgcgtggatattgtctgagtgctcgcctctgtcgacccagagctagaagcgaagacgaccctaccaaaccttcctactatactagtacggtaaccagtacaacgtcccggacccttaacggaccggggttccctagggtaacccgtactttccgtaccgtcgggtacctacccgtaacgttccgtacggtaccctacccgttacctaccggttcccccgttacccggttcgggtacccgtacggttcccggtccggttccgggggccctttacccgggggaacgggttccggttaacggaaaccggtaggttacgggtacgggttacctttaggttaattttaacgtttaacgttccgggtaacccttaacgggtttaccccttaagtaaacccggttaaaaccccgtaaacccggttaccccgtttagggggtttccggggtttttcgggggtttttccggtccggggtttccggggttttccgggggacccgggggaccccgggggtaaacccgttaacggggtttaacccccggg

SEQ ID NO: 401413 - DNA, 548 bp, Homo sapiens
  misc_feature: GZ8MTXP01CW6AJ.21.25.C03.1.454.CMB.2.raw
  modified_base (285)..(285): a, c, t, g, unknown or other
  modified_base (374)..(374): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtgccccanagctgaagcagagccctaccaaactcctcaatctatggtaaacccagcaaagtccggcccctacgaacggggtccctaggacctattcnctggctaccgaagtctggcacctcacgcctccctggtcagttcgctgggcctccgaggctagacgatggacggtctagtattattattgcctaagtcccttaagtgaacaaaccgtccccttggttcggttggtttttggcttcgggttcggcgggcgggtaaccgaacgtccg

SEQ ID NO: 401414 - DNA, 697 bp, Homo sapiens
  misc_feature: GZ8MTXP01ES3LI.21.25.C03.1.454.CMB.2.raw
  modified_base (294)..(294): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggcccccagacaccgagggcggctgcgtcagcacagactgggcccaggaccctgtgcagtgagcgaggagagtgaggaggagaggagaccgaggccagtgcgtggagtattgtcctggagtgctgcctcttgtcgccccangctagaacgcaagacgccctacccaaaactcctacaattctaagtacggtaaaccacggacaaacgtcccggcccctaacgggaacggggtcccctaggacccgtattcctcgtcgggccttaccaacgtcgtcggcctacctcgacgtccccttcccgtggtccacgtccggcgtcgggtcccttccgggaacggtcgttacggaacgtagttacggaacggtcttaaggtacttttaaagtttcgttacgtcccgtaaacggtttacccttaagtaccggttaaaccctaaacccgttaaccccggtttgggttcccgggtttttggggtttttcgggccgtttcggggtttcccgggggacggggttacccggggttaacccgttaaacgggttcccggg

SEQ ID NO: 401415 - DNA, 610 bp, Homo sapiens
  misc_feature: GZ8MTXP01DNKWL.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtctgagtgctgcctcttgtcgccccanagctgaacgcagcaccctaccaaactcctacatctagtacggtaaaccacgacaacgtcccggaccccgtacgaccgggggttcccctagtaacccgtatttcctcgtcggtcctaccgtagtctcggccacctcacgtccctccgtggtccacgtcgcgtcgggtcctcggggacggtcgtacggacgagtcggaggtcttaagtactttattacgttcgcctaacgttccttagtaccaacctaaccgtcccgttggttcggttttcgggttttcggcgttcgggttccggggccgggttaccgggtaaccgaacggtccg

SEQ ID NO: 401416 - DNA, 601 bp, Homo sapiens
  misc_feature: GZ8MTXP01DTCWT.21.25.C03.1.454.CMB.2.raw
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtctgagtgctgcctcgttgtcgcccanagctagaagcagacgcctaccaaaacttcctacatactatacggtaaaccaggacaaacgtccggacccctacggtaacggggtcccctgtaacccgtatttcctcgtacgggccttacctaagttctacggccacttcacgtcccgttccctggtccacgttcgcgttgggcctaccggacggtctgaccgagttggacgcgttagtaatttattacgtcgtccgtaagtcccttatacgaacaaaccgtcccttaggttcgtttgggttttcggcgttcggttcgggcggttcgggaaccgttaaggtccg

SEQ ID NO: 401417 - DNA, 657 bp, Homo sapiens
  misc_feature: GZ8MTXP01AVJS2.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccagagctagaagcaagacgccctaccaaactcctactaattcctagtacggtaaacccaggtactaaacgtcccggacccctacgtacgggggtccctggacccgtacttccgtcgtcgggacctaccgaacgttcgtcggacccacctccgacgtccccttcccgtcggtccacgtccgcgtcggggtccttccgggagggtccgtacgacggtagtggaacgtcgttaggtaattttagttacgttcgaccgttaacgttacccttaaggtacgaaacctaaaccgtccccgttaggttccgggtttggggtttttcgggcgtttcggggttcccggggcggggttaccggggaaccgttaacggttcccgg

SEQ ID NO: 401418 - DNA, 623 bp, Homo sapiens
  misc_feature: GZ8MTXP01BNKHC.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagagggagaccgaggccagtgcgtggagtattgtcctggagtgctgcctcttgtcgcccacagctagaagcgaagacgccctacccaaactcctactatctaatacggtaaacaggacaacgtcccggccctacgacggggtcccagacccgtattctcgtcggaccttaccgaacgttcgtacggtccaccctcacgtcccctcccgtggtccacgttccgcgtcgggtccctccgggacggtcgtacggaccgtagtggaacggtcgttaggttaatttagttaagttccgcctaacgttccttagttacgaacctaaacctccccgttggttcgtttgggttttcgcggttcggttccgggcgggaccgggtaaccgttaacggtccg

SEQ ID NO: 401419 - DNA, 595 bp, Homo sapiens
  misc_feature: GZ8MTXP01A4RHP.21.25.C03.1.454.CMB.2.raw
  modified_base (284)..(284): a, c, t, g, unknown or other
  modified_base (318)..(318): a, c, t, g, unknown or other
  modified_base (338)..(338): a, c, t, g, unknown or other
  modified_base (373)..(373): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctctgtcgcccangctagaagcaagacgtccctaccaaacctcctanatactagtacggtaaacccnggactaagtcccggccctaacggacggggttcccngtacccgtatttccctagtcggccttaccgaagtcgtcggaccaccgttcacgtccctcccgtcggtcacgtcgcgttcggggcctccgggaacggtcgtacgacgtagtcgacggtctagttatttattagtcgccgtaacgttcttagtacgaaccgtaaccgtccgttgttcggtttggtttcggcgttcgggtcgggcggaccggtaacgaacgtccg

SEQ ID NO: 401420 - DNA, 679 bp, Homo sapiens
  misc_feature: GZ8MTXP01B0OB2.21.25.C03.1.454.CMB.2.raw
  modified_base (285)..(285): a, c, t, g, unknown or other
  modified_base (385)..(385): a, c, t, g, unknown or other
  modified_base (450)..(450): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgcgtggagtattgtctgagtgctgcctcttgcgccangctagaagcagacgtccctaccaaactcctacatcctagtaggtaaccacgtcaaacgtcccggcccctaacgggaccggggtcccctaggtaacccgtntttccgtcgttacgggcctaccgaagttcctcggaccacccgtccacgtccccttccgtcggtcncgttccgcgtcggggtccctccgggacgggtctacggaacggtacgtcggaacggtcgtagttaattttacgttaacgttcggccccttaaggttaccccttaagtaccgttaacccgtaaacccgttccccgtttggggttcccgggtttttggggtttttcggtcccggtttcggggttcccgggggcccggggttaacccggggaacccgttaaacgggttcccgg

SEQ ID NO: 401421 - DNA, 756 bp, Homo sapiens
  misc_feature: GZ8MTXP01EA85D.21.25.C03.1.454.CMB.2.raw
  modified_base (262)..(262): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagatgtccngagtgctgcctcttgtcgcccangctgagcagacgcctaccaaactcctacattctaatcggtaaaccaggtcaaacgtccggcccctacggaacgggggttcccctaggtaacccggtactttccgtccgtcggggtaccttacccgtaaacggttccgtacgggcccaacccttccgtaaccgtaccccgttaccccgttcgggtcctaacgtccggtaccgttcgggggtacccttcccggggaacgggtcccgttacgggaaccggtaagttacgggaagggtccgttaggttaacttttaagtttacgttaccggtacccgtaacgggtttacccttaaagttacggttaaacccgtaaacccgttaaccccggtttacgggttcccggggttttggggtttttttaacggggtccggttttccggggttttcccgggggacccgggggttacccgggggtaacccccgttaaacggggttcccccggg

SEQ ID NO: 401422 - DNA, 592 bp, Homo sapiens
  misc_feature: GZ8MTXP01CLW1B.21.25.C03.1.454.CMB.2.raw
  modified_base (289)..(289): a, c, t, g, unknown or other
  modified_base (336)..(336): a, c, t, g, unknown or other
  modified_base (381)..(381): a, c, t, g, unknown or other
  modified_base (459)..(459): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagagggagaccaggccatgcgtggagattgtcctgagtgctgccttctgtcgcccanagctgaagcagacgcctaccaaactcctacatctagtcggtaaaccngacaacgtccggccctacggacggggtccctgacccgtatttccncgtcggctaccaagtctcggccacctcacgtcccttcccgtggtaccagttccgcgtcgggcctccggaggctgacgngtgacggctagtatttagttattcggcctaaggtccttagtacgaacctaaaccgtccccgttggttccggtttggtttttcgggcgtttcgggttccggggtcggggcccgggtaaccgttaacggtcccgg

SEQ ID NO: 401423 - DNA, 666 bp, Homo sapiens
  misc_feature: GZ8MTXP01CCSVZ.21.25.C03.1.454.CMB.2.raw
  modified_base (263)..(263): a, c, t, g, unknown or other
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtccngagtgctgcctntgtcgcccagngctgaagcagacgccctaccaaactcctacatctatacggtaaccagactaacgtcccggcccttaacgggaccggggttccctggaacccgtattcctcgtcgggcctaccgaagttcgtcggcctaccctcgaccgtccccttcccgtggtccacgttccgcgtcggggcccttaccgggacggtccgtacggaccgtagtacggacggtcttagttaatttatttaacgttccgtacccgttaacgttacccttaaagtacccggttaaacctaaacccgtcccgttcggtttccgggttttcgggggttttttcggtcgtttcggggtttcccggggacgggggttacccggggtaacccgttaacgggtccccgg

SEQ ID NO: 401424 - DNA, 667 bp, Homo sapiens
  misc_feature: GZ8MTXP01D1FI6.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgcgtggagattgtcctggagtgctgtcctcttgtcgcccatgctggaagcaagacgccctaccaaaactcctacattcggtaatacggtaaaccaggactaaacgtcccggcccctacggaacggggttcccctagacccgtatttccgcgtcggccttacccgtaagtccttcggccacctccaccgtccccttacccgttggtccacgtccgtcgtcgggccttcccggaggtccgtagaccgtaagtggaacggtcttagttaaatttagtttaacgtttcggaccttaacggttcccttaacgttacgaaaccctaaacccgttaccccgttggtttcggttttcgggtttttcgggtccgtttcgggtttcccggggcggggttacccgggtaacccgttaaacggtcccgg

SEQ ID NO: 401425 - DNA, 601 bp, Homo sapiens
  misc_feature: GZ8MTXP01DSND7.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactcggggcccaggaccctgtgcagtgagcgaggagagtgaggaggagaggagaccaggccatgctggagattgtctgagtgctgcctcttgtgcccatagctagaagcagacgccctaccaaaactcctacatctatacggtaaccacgtacaaacgtcccgggcccctaacgacgggggttcccctgacccgtattctaccgtggacctacctaagtctcggcctacctcgacgtccctcccgttggtcctagtccgtcgtcgggtccttaccgggagggtccttaggaaccggtagtggaacgcttaggtaatttagttattcgctaagtccttagtacgaacctaacctacccgttggttcgtttggttttcggcgttgggttcgggcggttcgggtaacaacggtcccg

SEQ ID NO: 401426 - DNA, 618 bp, Homo sapiens
  misc_feature: GZ8MTXP01DXX4Z.21.25.C03.1.454.CMB.2.raw
  modified_base (323)..(323): a, c, t, g, unknown or other
  modified_base (391)..(391): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagtattgtctgagtgctgccttcttgtcgcccctacaggctagaagcgagacgccctaccaaactcctanattcatacggtaaaccaggacaacgtcccggaccctacggacgggggttcccctgacccgtatttccncgtcgggaccttacccaagttctcggccaccctcgacgtcccctcccgtggtcctacgtccgcgttcgggcccttccgggacggctacggaaccgtagtggaggtccttaggtaatttattacgtttcgccctaagttcccttatacgttaccaaaccgtcccgttggttccggtttgggttttcgcgttggttcccggggacgggaccgggtaaccgaaggtcccg

SEQ ID NO: 401427 - DNA, 657 bp, Homo sapiens
  misc_feature: GZ8MTXP01BLR7T.21.25.C03.1.454.CMB.2.raw
  modified_base (295)..(295): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccgaggccagtgcgtgggagtagttgtcctggagtgctgcctcttgtcgcccanagctagaagcagacgccctaccaaacctcctactatactaagtacggtaaaccaggacaaacgttcccgggacccctacggaacggggttcccctaggaacccgtatttcccgtcgtcgggtacctacccgtaaacgtccgtcggacctacccgttacacggtccccttcccgtggtaccacgttccgcgtcgggtccctacggtaacggcgtacgaaccggtagtggaggtccgttaggtactttaagttacttcgacctaagtcccttagtacgaacctaaaccgtaccgttcggttcggtttcggtttcgggtcgttcgggttccgggacggggttaccgggtaaccgaagggttcccg

SEQ ID NO: 401428 - DNA, 722 bp, Homo sapiens
  misc_feature: GZ8MTXP01AKH6L.21.25.C03.1.454.CMB.2.raw
  modified_base (263)..(263): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtccngagtgctgcctcttgtcgcccanagctgaagcagacgccctaccaaactcctcatctatacggtaaccagcaagtccggccctcgacgggggtccctggacccgtatttccgtcgtcgggccttacccgtaaacgttccgttcgggaccctaacccgttccgaacggtccccttccccgttcgggtcctaacgttcccggtccggttcgggggtcccttcccgggaacggggtccgttacgggaacccggtaacgttgggaacgggtccgtttacggtaacttttaagttttaacgtttccggccccgttaacggttccccttaaagttaccggttaaaccctaaaccccgtaaccccgttcgggtttcccgggttttcggggttttttcgggtccggtttcggggtttcccggggacccgggggttaccggggtaaccccgttaaacgggttccccgg

SEQ ID NO: 401429 - DNA, 707 bp, Homo sapiens
  misc_feature: GZ8MTXP01BHD1P.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgcgtggagattgtcctgagtgctgcctcttgtcgccccacgagctagaagcagacgccctaccaaaccttcctacacttctaagtacggtaaacccaggacaaacgtcccggcccctacggtaaccgggggtcccctaggaaccccgtatttcctccgtcgggtaccctacccgtaacgtccgtacgggccctaacccgtccgtaccggtccccttccccgttcggtacctacgttccggtccggtcggggtccctacccgggacgggtccgtacggaaccgtaggtcggacgggtaccttaggtaacttttaatttaacgttccgacccgttaacgttcccttaaagtaccgaaaccctaaacccgtaccccgttgggttccgggttttggggtttttcgggtccgtttcggggtttccggggacccggggttacccgggtaaccgttaacggtcccgg

SEQ ID NO: 401430 - DNA, 540 bp, Homo sapiens
  misc_feature: GZ8MTXP01B07BG.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctaccaaactcctacatctatcggtaaccagcaatccggccctcgacggggtccctgacccgtattcctctgggcctacctaacgtctacgggcacctccacgtccctcccgtggtcactcgctgggcctcgaggctgacgagtgaggctagtattattattcgctaacgtccttatcgactaactacccttgttcggttggttttggcgtggttcggcggcgggtaaccgaacgtccg

SEQ ID NO: 401431 - DNA, 660 bp, Homo sapiens
  misc_feature: GZ8MTXP01APAFB.21.25.C03.1.454.CMB.2.raw
  modified_base (263)..(263): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtccngagtgctgcctctgtcgcccanagctagaagcagacgcctaccaaacctcctcatctatggtaaacccagcaaacgtccggacccctacgaacgggggtcccctaggaccccgtatttcctcgttcgggacccttacccgaaacgttccgttcgggaccctaaccccgttccgacgtcccccgttccccgttcgggtcccacgttccgtccgtcgggggtccctcccgggacgggccgttcggaaccgtagtcggagggtaccttggttaactttagtttacttcgccgtaacggttaccttacgtacgaaccaaacccgtacccgttggttccggtttgggtttttcgggcgttcgggttccggggtccggggccggggtaacccgaacggtcccg

SEQ ID NO: 401432 - DNA, 965 bp, Homo sapiens
  misc_feature: GZ8MTXP01BBT1Z.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtcgggcccacggaccctgtgcagtgagcgaggagagtggaaggaggagagggacgaccgaggccatgcgtagggatagttcgtccgtggagtcgctcgtcccttcgtttaggccgacccccaacgacgtcccgttaaggaaacggccaaagggaccgtaccccctaaacccctaaaaaccctttcccctactaactttaccttaaaggttaaccggggttaaaacccccacggtacctaaaacggttcccccggggtaccccctaacggggtaaccccgggggggtttccccctacggggaaaccccggttactttttccccgtaccgggttacggggacccctttaacccggtaaacggtttcccgttacggggaaccccgtaccccttacccgaacccggttaccccccgtttaccccggttcggggttacccctaaccggttccgggtaccccgggttacggggggtcccctttaaccccgggggaacggggttacccgtttacgggaaacccggtagggttaccgggaagggttcccgttaagggtttaaaccttttaaggtttaactttcccggtaaccctttaaccgttttaacccttaaacgtttaaacccgggaaacccctaaaaccccgttaaccccgggttttaccgggtttccggggtttttaccgggggtttttttccggggccgggtttttccgggggtttacccgggggacccgggggttaaccccggggtaaaccggttaaacccggggttaaccccggg

SEQ ID NO: 401433 - DNA, 582 bp, Homo sapiens
  misc_feature: GZ8MTXP01EQ2U8.21.25.C03.1.454.CMB.2.raw
  modified_base (263)..(263): a, c, t, g, unknown or other
  modified_base (287)..(287): a, c, t, g, unknown or other
  modified_base (319)..(319): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcngagtgctgtcctcttgtcgcccanagctagaagcagacgccctaccaaactcctanattctagtacggtaaaccaggacaacgtcccggccctacggaacggggtccctggacccgtattctcgtggcctacagtctcggccacctcgacgtcccctccgtggtcacgtccgcgtacgcctaccggaggtctacgacgtagtggaggtctagtatttagttacgtcgcctaacgttccttatcgaacctaaaccgtcccgttgttcggtttgggttttcggcgttcgggtcgggccgggacggtaaccgttaagtccgg

SEQ ID NO: 401434 - DNA, 662 bp, Homo sapiens
  misc_feature: GZ8MTXP01AN917.21.25.C03.1.454.CMB.2.raw
  modified_base (260)..(260): a, c, t, g, unknown or other
  modified_base (281)..(281): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggcatgctggagtatgtcngagtgctgcctctgcgcccangctgaagcagacgccctaccaaactcctacattactaagtacggtaaacccaggactaacgtcccggaccctaacgggaccgggggttcccctaggtacccgtactttccgtacgtcgggtacccttacccgtaacgttccgtacgggaccctacccgttaccgacccgtcccccgttccccgttcgggtcccacgttccggtccggtcggggtccctaccggggacggtcgtacgggaacgagtggacggtcttagttatttattagttccgcctaacgttccttataccgaacctaaccgtcccgttggttcggtttcgggttttcggcgtttcgggttccggggaccgggttaccgggtaacccgttaacggtcccgg

SEQ ID NO: 401435 - DNA, 663 bp, Homo sapiens
  misc_feature: GZ8MTXP01EFABD.21.25.C03.1.454.CMB.2.raw
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgctggagattgctgagtgctgctctgtcgcccanagctgaagcaagacgccctaccaaacttcctacattcctatacggtaaaccaggacaagtcccggcccctaacggacgggggttccccagacccgtatttccgtcgttcgggccttaccgtaagttccgtcggaccctacctccgacgtccccttcccgttacggtcacgttcccgcgtcggggtccctcccgggtaagggtccgttaggaaaccggtagttcggaacggggttccttaaggttaactttaagttttacgttcgtaccgttaacggttcccttaaagtcggttaaacctaacccgtaccccgtttgggttccggtttttggggttttcgcgtttcgggttccggcgggttcgtaaccgaaccgtaacgg

SEQ ID NO: 401436 - DNA, 591 bp, Homo sapiens
  misc_feature: GZ8MTXP01A5WYI.21.25.C03.1.454.CMB.2.raw
  modified_base (285)..(285): a, c, t, g, unknown or other
  modified_base (314)..(314): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccangctgaagcagacgccctaccaaactccanatctaatggtaaaccagacaatcccgggccctacgacgggggtcccctaggacccgtatttccgtcgtcgggcccttacccgaaagttcctcgggaccaccctcgacgtccccttcccgtcgggtccacgttccgcgtcgggcctccggaggtctgacgatggacggtctagtatttaattattcgctaacgttccttatacgacctaacctacccgttggttcggttcgggttttcggcgttcggttcgggcgggttacgggaaccgaacggtccg

SEQ ID NO: 401437 - DNA, 630 bp, Homo sapiens
  misc_feature: GZ8MTXP01ANR7K.21.25.C03.1.454.CMB.2.raw
  modified_base (273)..(273): a, c, t, g, unknown or other
  modified_base (283)..(283): a, c, t, g, unknown or other
  modified_base (312)..(312): a, c, t, g, unknown or other
  modified_base (328)..(328): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgtctgagtgctgcctntgtcgcccanagctgaagcagacgcctaccaaactcctnatctagtggtaaaccngacaagtccggccctgacggggtccctgaccgattctcgtaggcctacccgaagtccgtgggaccacccgtcacggtcccctcccgtcgggtccacgtcccgtcgtcggggcctacccgggagggtccgtcggaaccggtagttacggagggtcctaggttactttaagtttattcggccctaaggttcccttaagtccggttaaacctaaacccgtacccgtttcgggttcccggtttggggtttttcgggtcgtttcgggttccggggccggggttaccgggaaccgttaacggtcccgg

SEQ ID NO: 401438 - DNA, 681 bp, Homo sapiens
  misc_feature: GZ8MTXP01BDTD4.21.25.C03.1.454.CMB.2.raw
  modified_base (269)..(269): a, c, t, g, unknown or other
  modified_base (291)..(291): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagacgtcgggcccaggaccctgtgcagtgagcgaggagagtgaggaggagaggagaccaggccagtgcgtggagtagttgtcngagtgctgcctcttgcgcccanagctagaagcaagacgccctacccaaactcctacactctatagaactaaacagacaacgtcccggaaccctcgcggggtccctaggacccgtacttcgtcgtcgggtaccctaccgaagttccgtacggaccctacccgttaccgaccgttccccgttcccgtcggtacccacgttccggtccgttccgggacccgtccggtaacgggtcctacggaccggtagtacgggtacggtacttaggttaaattttacgtttaacgttccggtaaccttacggttaccttaacgttaccgaaacccgtaaccttaccccgtttggtttccgggtttgggttttcggtaacgtttcggggttccggaccggggtaaccggttaaccgtaaccggg

SEQ ID NO: 401439 - DNA, 706 bp, Homo sapiens
  misc_feature: GZ8MTXP01CAHBQ.21.25.C03.1.454.CMB.2.raw
  modified_base (266)..(266): a, c, t, g, unknown or other
  modified_base (288)..(288): a, c, t, g, unknown or other
  modified_base (337)..(337): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtgggcccaggaccctgtgcagtgagcgaggagagtgaggaggagaggagaccaggccagtgcgtggagtattgtcngagtgctgcctctgtcgcccangctagagcagacgcctaccaaactcctacattctaagtacggtaaaccnggtacaaacgtcccgggccctaacgggaaccgggggttcccctagggtaaaccccgttactttccgtaccgtcgggtaccctaacccgtaacgttccgttcggacctaaccctccgaccgtccccttacccgtggtccacgtccgtcgtcgggtccctaccggggaacgggtctacggaaccggtagtacgggaacggtcgttaggttaacttttaagttaacgtttcgacccgttaacgttaccctttaaaggttacgaaaccctaaacccgttacccgtttagggttcggttttacggggtttttcggcggtttcggggttcccgggggaccggggttaccggggtaacccgttaacggttcccggg

SEQ ID NO: 401440 - DNA, 593 bp, Homo sapiens
  misc_feature: GZ8MTXP01B60QM.21.25.C03.1.454.CMB.2.raw
  modified_base (288)..(288): a, c, t, g, unknown or other
  modified_base (482)..(482): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccctggggcccccagacaccgagggcggctgcgtcagcacagactgggcccaggaccctgtgcagtgagcgaggagagtgaggaggagaggagaccaggccatgctgggagattgtcctgagtgctgcctctgtcgcccanagctgaagcaagacgccctaccaaacctcctacattctatacggtaaacccaggcaaagtcccggcccttacggacgggggtccctggaacccgtatttcctcgtcggcctaccctaagtcgtcggcctacctccacgtcccctccgtggtccagtccgcgtcgggccttaccggaggtcctggacggtatggngcgtagtatttacgtatttcgcctaagttcccttagtacgacctaaaccgtcccgttggttcgtttgggttttcggcgttcggttccgggcggaccgggtaacgaacgtcg

SEQ ID NO: 401441 - DNA, 596 bp, Homo sapiens
  misc_feature: GZ8MTXP01BG9JS.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgcgtggagattgtcctgagtgctgcctcttgtcgcccacagctgaacgcagacgcctacccaaactcctacatctatggtaaaccagacaagtcccggccctacggacggggtccctgacccgtattcctcgtcgggctaccgagtctcggccacctccacgtccctcccgtggtccacgtccgcgtcgggcctccggacggcgtcgacgtagtcggagtcgttagtatttattacgttcgcctaacgtccttatacgacctaaccgtacccgttggttcggtttcgggtttttcggcgtttcgggtttccggggccgggttaccgggtaacccgttaacggtcccg

SEQ ID NO: 401442 - DNA, 643 bp, Homo sapiens
  misc_feature: GZ8MTXP01EXS0K.21.25.C03.1.454.CMB.2.raw
  modified_base (265)..(265): a, c, t, g, unknown or other
  modified_base (287)..(287): a, c, t, g, unknown or other
  modified_base (294)..(294): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgcgtggagattgtcgngagtgctgcctcttgcgcccangctgaancagacgcctaccaaactcctacatactatacggtaaaccagactaaacgtcccgggacccctacggacggggttccctacggacccgtacttccgtccgtgggtcctacccgtaagtcgtcggcctaccctccacgtcccctcccgtcggtcctacgtcgcgtcgggccctaccggggacggtcgtacggacgtagtcggaggtcttaggtatttaatttacgtccgtcctaacggtaccttagtacgttaaaccaaaccctacccggttcggttccggttttcgggttttgggtcgtttcggggtttcccggggccgggttaccggggtaacccgttaacgggtcccg

SEQ ID NO: 401443 - DNA, 758 bp, Homo sapiens
  misc_feature: GZ8MTXP01EG1KX.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtgaggaggagaggacgacgaggccagtgcgtaggagtagttcggtccgtggaggtcgtctcgtccgttcgttcggtccgaccccaagacggtccgtaggaaacgccgaaggtacccgtacccctaacccctaaaaccttccctagtaacttacgtaagtacggtaaacccacgtactaacggtccccggcccgtaacgggtaccgggggttccctacggaacccgttactttcccgtacgtcgggtaccttacccgtaacgttcgtcggaccctacccgtaccgcccgttcccgttcccgtgtccgtacgtccgtcggtcgggcccgttaccggggaacggtccgttacggaacggtagtacggtacggttacgttaggttactttaacgttacgttccgacccttaacggttaccttagtaccggttaaaccgtaaacccgttccggttcgggtttcgggttttcgggttttcggtccggtttcggggttcccggggcggggttaccggtaacccgttaacggttccccgg

SEQ ID NO: 401444 - DNA, 622 bp, Homo sapiens
  misc_feature: GZ8MTXP01CE2AY.21.25.C03.1.454.CMB.2.raw
tcagtcgtcgctcgcacgaccggtgctcgatttagtagtgtagatttgggtttggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgcgtggagattgtcctgagtgctgccttcttgtcgccccacagctagaagcagacgcctaccaaactcctcatctataggtaaccagacaacgtcccggcccctaacgaccgggggttcccctaggtacccgtacttcctccgtcgggcctaccgtaacgttcgtcggtcctaccctccgaccgtccccttccccgtcggtcctacgtccgtcgtcgggcctccgggacggtccgtggacgagtgacggtcttagtattattagttcgcctaacgtccttatacgaacctaacctacccgttcggttcggtttcgggtttttcggtcgtttcgggttccgggtccgggttaccgggtaacccgaacggtcccg

SEQ ID NO: 401445 - DNA, 665 bp, Homo sapiens
  misc_feature: GZ8MTXP01DYZMT.21.25.C03.1.454.CMB.2.raw
  modified_base (286)..(286): a, c, t, g, unknown or other
  modified_base (318)..(318): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccangctgaacgcagacgccctacccaaactcctanactctataggtaaacccagacctaaacgtcccggacccctcggaaccgggggttccctacggtaacccgtatttccgtcgtcggcctacccgtaagtctggccaccgtctacgcccttcccgtgggttaccagtccgtcgtcgggtcctcggacggtcgtaccggacgtagtcggaggtacttaggttaatttacgtttaacgttccggaacctaacggtttacccttaagtaccggttaaacctaaacccgttaccccgtttgggttcgggttttcggggtttttcgggtccgtttcggggtttccggggccggggttaccggggaaccgttaacggttccccggg

SEQ ID NO: 401446 - DNA, 679 bp, Homo sapiens
  misc_feature: GZ8MTXP01DBZZ1.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccagtgcgtggagtattcgtccgtggagtgtctgcccttctttcggcgccccaacgacggtctaggaaacgccgaaggaccgccccttaacccaaaactccctacacttacctagtacggtaaaccacggacctaacgtccccgggaccccttaaccgggaccgggggttcccctagggtaaccccgtatttcccgtacgtcgggtaccctaccgtaacgttcgtacggcctaccctctaccgtcccttcccgtgtacctacgtccgtcgtcgggtccctcgggacggtcgtaggacgtaagtcggacggtcttaagtatttacgttactcgacctaagttccttagtacgaacctaaaccgtccgttacggttcggtttcgggttttcggcgttcgggttccgggcgggttaccggtaaccgaacggtcccg

SEQ ID NO: 401447 - DNA, 652 bp, Homo sapiens
  misc_feature: GZ8MTXP01CAKJ7.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagagttgtcctggagtgctgcctcttgtcgccccaacagctagaacgcaaggacgcccttacccaaaacttcctactactctatacggtaaaccagacaatcccggccctacgacggggtccctagacccgtatttcctcgtcgggctaccgaagtcgtacggccacctccacgtccccttcccgtggtccacgtccgcgtcgggccttccgggacggtcgtcgaaccggagttcggaacggtcttaggtactttaagtttacgtttacggccctaaggttcccttagttaccgaaaccgtaaaacctcccgttacggttccggtttgggtttttccgggtcgtttcggggtttccggggaccggggttacccgggaaccgttaaccgggttcccggg

SEQ ID NO: 401448 - DNA, 710 bp, Homo sapiens
  misc_feature: GZ8MTXP01AGMPZ.21.25.C03.1.454.CMB.2.raw
  modified_base (264)..(264): a, c, t, g, unknown or other
  modified_base (287)..(287): a, c, t, g, unknown or other
  modified_base (334)..(334): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggccccaggaccctgtgcaggtgagcgaggagagtgaggaggagaggagacaggcatgctggagtattgtccngagtgctgcctcttgtcgcccangctgaagcagacgcctaccaaactcctacatctaatacggtaaaccncggactaacgtcccggccctaacggacgggggttcccctgggaccgtaactttccgtcgtacgggccttacccgtaacgttccgtacggcctaacccgttccgacggtccccttcccgttcgggtacctacgttccggtccggttcggggcccttccgggggaacggtccgttaacgggaaccggtaacgttagggaacggtccgttaggttaactttaagtttaacgtttccgggacccttaaggttacccttaacgttaccggaaaccctaacccgttaaccccggttgggttccggttttcggggtttttcgggccgtttcgggggttcccggggtcgggggacccgggtaaccgttaaccgggttccccggg

SEQ ID NO: 401449 - DNA, 803 bp, Homo sapiens
  misc_feature: GZ8MTXP01EMS5Z.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagatgctcccagcgcaggagatggtgaccgtctgccctggggccccagacaccggagggcggctgcgtcagcacagacgtcggcccaggaccctgtgcagtgagcgaggagagtggaggaggagaggagaccgaggccagtgcgtaggagtagttgtccgtggagtcggtcctcgtcccttcgtttcggtcgccccaagacggtctaggaaacgcaaacggaccgtacccctaaccctaaaaccttccctactaacttacctaagttaacgggtaaaacccacggtacctaaacggttccccgggtacccccgttaacgggtaaacccgggggttccccttacgggaacccggtactttcccgtcgtttcggggacccttacccgtaaacgttccgtaccgggacctaaccccgttccgaccggtccccgttcccgttcgggtacctaccgttccggccggtcggggtccctcccggggcgggtccgttacgggaccggtacgttagggaacggttcgttacggttaactttaagtttaacgttccggtacccgtaacggtttacccttaacgtaccggaaacctaaacccgttaccccgttgggtttcgggttttcggggtttttcgggtccggtttcgggttcccgggggtaccgggttaccggggtaacccgttaacgggttccccgg

SEQ ID NO: 401450 - DNA, 626 bp, Homo sapiens
  misc_feature: GZ8MTXP01AOECD.21.25.C03.1.454.CMB.2.raw
  modified_base (298)..(298): a, c, t, g, unknown or other
  modified_base (330)..(330): a, c, t, g, unknown or other
  modified_base (348)..(348): a, c, t, g, unknown or other
  modified_base (507)..(507): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccgaggccatgcgtggagtattgtcctggagtgctcgcccttcgttgtacgccccagnggctagaagcagacgtcccctacaaactcctnatctaagtggtaaacccngactaaacgtcccggacccttacgggacggggtttccccaggacccgttattccgtcgtcgggccttacccgaagttcgtacggtacccacccttccgacgtcccccgttcgtcggttaccgacgttccgtcgttcggggtacctccgggaaggttcgnggacgtatcggaggtcttagtaatttagttacgtcgacgtaagtccttatacgacctaaccgtccgttgttccggttggttttaacgcgtcgttcgggaccggcggtaacgaagtcccg

SEQ ID NO: 401451 - DNA, 685 bp, Homo sapiens
  misc_feature: GZ8MTXP01AHZYO.21.25.C03.1.454.CMB.2.raw
  modified_base (265)..(265): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctgggccccagacaccgagggcggctgcgtcagcacagacgtcggcccaggaccctgtgcagtgagcgaggagagtgaggaggagaggagaccaggccatgcgtggagattgtccngagtgctgtccttctgtcgcccagacgctagaacgcaacgacgtcccctaccaaacctcctactatacgttaagtacggtaaacccagactaaacgtcccggtccccgtaacgggtacccggggttcccctacggaacccgtactttccgtccgttcgggtaccttacccgaagtttccgtcgggaccctacccgttcacccgtccccgttcccgtggtccacgtccgtcgttacgggcctccgggaggcgtacgaccggtattcggacggtcttacggtatttagttaacgttcggccctaacgttaacccttagtaaccgttaaacctaaacccgtccccgttgggttccggttttgggtttcgggccgtttcggggttaccggggccgggttacccgggaaccttaacggttccccg

SEQ ID NO: 401452 - DNA, 514 bp, Homo sapiens
  misc_feature: GZ8MTXP01DKHGK.21.25.C03.1.454.CMB.2.raw
  modified_base (357)..(357): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagcctaccaaactcctcatctatggtaaaccagcaaatccggccctacgacggggtcccngacccgattcctctggctccaagtctggcacctcacgccctccctggtcatcgctcgggctccgaggctgacgatgaggctgtattattatgccaagtccttatgacaacacccttgttcgttggttttggctgttcggcggcgggtaacgaagtcg

SEQ ID NO: 401453 - DNA, 518 bp, Homo sapiens
  misc_feature: GZ8MTXP01AY0KL.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagcctacccaaactcctcatctaatggtaaacccaggacaaatccgggcccctacgacgggggttcccctggacccgattcctctgggctccaagtctggcacctcagccctccctggtcatcgctgggcctccgaggctgacgatgaggctgtattatattgcctgtccttatgacaacacccttgcgttggtttgctggttcggcggcggaacaagtcg

SEQ ID NO: 401454 - DNA, 783 bp, Homo sapiens
  misc_feature: GZ8MTXP01B4O9P.21.25.C03.1.454.CMB.2.raw
  modified_base (275)..(275): a, c, t, g, unknown or other
  modified_base (288)..(288): a, c, t, g, unknown or other
  modified_base (299)..(299): a, c, t, g, unknown or other
  modified_base (308)..(308): a, c, t, g, unknown or other
  modified_base (333)..(333): a, c, t, g, unknown or other
  modified_base (355)..(355): a, c, t, g, unknown or other
  modified_base (406)..(406): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtcgggcccacggaccctgtgcagtgagcgaggagagtggaggaggagaggacgaccgaggccagtgcgtggatagttcgtccngagtgctgccttnttgcgcccagngcgtagaancaagacgccctaaccaaacttccanacttcgtaagtacggtaaaccnggacaaacgtcccggtaccctaacgggaccgggttcccaggtaaacccgtntttccgacgtcgggacctaccgtaacgtcgtaccggacctaccctcgacccgttccccttccgtacggtacctacgtccggtcggtcgggtaccccttaccggggacggtccgttacgggaaccgtgtacgggtacggttccgtttaagttaacttttaaggttttaccgttccggtacccgttaaacgtttacccgtttaacggtaaacccgggttaaaccctaaaaccccgggtttacccggtttccggggttttcgggggttttttacgggggttttttaaccggggcccggttttaacggggggtttacccccggggggaccgggggttaaccccggggttaaaaccccgttaacgggggttttcccccgggg

SEQ ID NO: 401455 - DNA, 652 bp, Homo sapiens
  misc_feature: GZ8MTXP01AZTFR.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccacagctagaacgcagacgcctaccaaactcctcatctatggtaaaccagacaactccggccctacgacggggtcccctagacccgtattcctacgtcgggtacctacccgtaaagtccgtacggccctaaccctccaacgtccccttccccgttggtccagttcccgcgttacggggcctcccggaggtccgtcggaccgtaacgttgaacggggtcttaggtaactttattaacgtttcgaccgtaacggttacccttaagtccgaaaccgtaaaccgtccccggttggttcgggttttcggggtttttcgggtccgtttcggggttccggggccgggggttaccgggtaacccgttaacgggtcccg

SEQ ID NO: 401456 - DNA, 650 bp, Homo sapiens
  misc_feature: GZ8MTXP01C7KM6.21.25.C03.1.454.CMB.2.raw
  modified_base (292)..(292): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactcgggcccaggaccctgtgcagtgagcgagagagtggaggaggagaggagaccaggccagtgcgtggagtattgtcctgagtgctcgcctcttgtcgccccanagctagaagcagacgtccctaccaaactcctacatactagtacggtaaaccagacaacgtcccggccccttaacggaccggggttcccctggtaacccgtactttcctcgtcggcctaccgtaacgtcgtcggccacctccgacgccccttccctgtccacgtccgtcgtcgggcctccggacggtcgtacgacgtagtggaggtcgtagtatttacttagttccgtaccgtaacgttcccttaagtacgaaacctaaacccgtacccgttcgggtttcgggtttcgggttttttcggccggtttcgggttcccgggggtaccgggttaccggggtaacccgttaaacggtccccggg

SEQ ID NO: 401457 - DNA, 626 bp, Homo sapiens
  misc_feature: GZ8MTXP01DHI0H.21.25.C03.1.454.CMB.2.raw
  modified_base (281)..(281): a, c, t, g, unknown or other
  modified_base (287)..(287): a, c, t, g, unknown or other
  modified_base (292)..(292): a, c, t, g, unknown or other
  modified_base (326)..(326): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtggaggaggagaggacgaccaggccagtgcgtggagtattgtctgagtgctgcctnttgtcncccangctagaacgcaagacgccctacccaaactcctanactctagtacggtaaaccagactaacgtcccggacccctaccggacgggggttcccctaggacccgtatttccgtccgtcgggtccctaccgaacgttcgtcggaccaccctcgaccgtcccttcccgtggtccacgtccgtcgtacgggcctccggacggtcgtacggacgtagtcggacggtcgttagtaactttattacgttcgccgtaacgttccttatacgaaacctaccgtacccgttgttccggtttgggttttcgtcgtcgggttccggcgggaccggtaacgaacggtccg

SEQ ID NO: 401458 - DNA, 687 bp, Homo sapiens
  misc_feature: GZ8MTXP01AJBVW.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggcatgctggagattgtctgagtgctgcctcttgtcgcccanagctagaagcaagacgtccctaacccaaaaccttcctacaacttctaagttacgggtaaaacccaggactaaacgtcccggaccctaacggaaccgggggttcccctagggtaacccgtatttccgtcgtcgggaccttaccgaacgttccgtacggcctacccgtcgaccgtccccttccgttcggtactcgtccgcggttcggggcccttaccggggaacgggtcgttacggaaccggtagttcgggacggtacttaggttaattttacgttaacgttccgacctaacgttaccttaagtaccgaaccctaaaccgtcccgttggttcgggttttcggttttcgggccgtttcgggttaccggggaccgggttaccgggaacccgttaacggttccccgg

SEQ ID NO: 401459 - DNA, 704 bp, Homo sapiens
  misc_feature: GZ8MTXP01BPDSP.21.25.C03.1.454.CMB.2.raw
  modified_base (263)..(263): a, c, t, g, unknown or other
  modified_base (275)..(275): a, c, t, g, unknown or other
  modified_base (285)..(285): a, c, t, g, unknown or other
  modified_base (334)..(334): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggcatgcgtggagattgtcngagtgctgcctntgtcgcccangctgaagcagacgccctaccaaactcctacatactagtacggtaaaccngtacaacgttcggccctacgacggggtccctaggtaacccgtcttccgtcgtcgggaccttaccgtaacgtccttcgggaccctacccttaccgaaccgtcccccgttcccgtcgggttacccacgttccggtccggtcggggtccctaccggggtaacgggtccgttacgggaaccggtaagttggaacgggtccttaaggttaacgttttaattaacgtttccgaacctaacggtttacccttaacgttaccggaaacctaaaaccccgtcccgtttcgggttcccgggttttggggtttttccgggcggtttccggggtttcgggggcccggggttaccgggggtaacccttaaagggttccccggg

SEQ ID NO: 401460 - DNA, 592 bp, Homo sapiens
  misc_feature: GZ8MTXP01D4YVU.21.25.C03.1.454.CMB.2.raw
  modified_base (269)..(269): a, c, t, g, unknown or other
  modified_base (291)..(291): a, c, t, g, unknown or other
  modified_base (375)..(375): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggcccccagacaccggagggcggctgcgtcagcacagactcgggcccaggaccctgtgcagtgagcgaggagagtgaggaggagaggagaccaggccagtgctggagtattgtcngagtgctgcctcttgcgcccangctagaacgcagacgccctaccaaactcctacattactagtaggtaaaccagacaacgtcccggccctacggacggggttcccngtacccgtattcctcgtacggcctaccgaagtctcggcctacctcacgtcccctccgtcggtccacgtcgcgtcgggtcctcggacggtcgtacgacgtagtcggagtcgttagttattattagttcgcctaagttccttagtacgaactaaacccgtcccgttggttcgtttgggttttggcgttcggttcgggcgggacggtaaccgaaggtccg

SEQ ID NO: 401461 - DNA, 679 bp, Homo sapiens
  misc_feature: GZ8MTXP01CO2V5.21.25.C03.1.454.CMB.2.raw
  modified_base (332)..(332): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgcgtaggagtattgtccgtgagtcgctgccttcgttggcgaccccagagctagaacgcaagacgtcctaccaaactcctanactactagtaggtaaaccagacaagtcccggccctaacggacgggtccctgacccgtattccgcgtcggtcctacgaacgtcgtacggccacctcgaccgtcccttcccgtgtccacgtccgtcgtcggggcctccgggaggtccgttacggaacgtacgtcgggacggtcttaggtaactttaacgttacgttaccggacccgttaacgttacccgttaagttaacccggaaaccgttaaaaccccgtcccggtttacgggttccgggtttttcggggtttttccgggcgtttcgggggttcccgggggaccggggttaccgggaacccgttaacgggtaacccgg

SEQ ID NO: 401462 - DNA, 608 bp, Homo sapiens
  misc_feature: GZ8MTXP01AXWC2.21.25.C03.1.454.CMB.2.raw
  modified_base (268)..(268): a, c, t, g, unknown or other
  modified_base (328)..(328): a, c, t, g, unknown or other
  modified_base (401)..(401): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggacgaccgaggccatgcgtggagtattgtccngagtgctgccttcgttgtcgccccagagctagaacgcaagacgcctacccaaactcctanagtactaagtacggtaaacccaggacaaagtcccggacccttacgggaaccggggttcccctggaacccgttnttccgtcgttcggctacccgaagttccgtcggacccaccctcgccgtccccgtcccgtgtcctacgttcgcgtcgggcctccggaggtccgtgacgtatggcgtgttagtatttagttatcgcctaagtcttagtacaacaaaccgtccgttcggttcggtttggttttcggcgtcggttcgggcgggttacggaaccgaagtcccg

SEQ ID NO: 401463 - DNA, 758 bp, Homo sapiens
  misc_feature: GZ8MTXP01DUBPM.21.25.C03.1.454.CMB.2.raw
  modified_base (393)..(393): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtcgggcccaggaccctgtgcagtgagcgaggagagtggaggaggagaggacgaccgagccagtgcgtaggatagttgtccgtggagtcgcttcgtccctttgttcggccgaccccagacggtctaaggaacgcgaacggaccgtaccccttaaccctaaaaccttccctaataacgttacgtaaagtacgggtaaaacccncggactaaacggtccccggtacccgtaacgggtacccggggttccctacgtacccgttattcccgtcgtacgggtcctaccgtaacgttcgtaccggcctaaccctccgtaccgtccccttacccggtgtaccctcgttccggtaccggtccgggtccgtaccgggtacggtccgttacgggaaccgtagtacgggtacggtactttacgttaagttttaaaccgtcgtttccgacccgttaagttacccttaaagtacccgaaaccgttacccgtacgttcggggtttcgttttcggggttttccgggtacggttcggggttcccggggaccgggttaccgggtaaccgaacggttaacccggg

SEQ ID NO: 401464 - DNA, 772 bp, Homo sapiens
  misc_feature: GZ8MTXP01AZI4S.21.25.C03.1.454.CMB.2.raw
  modified_base (263)..(263): a, c, t, g, unknown or other
  modified_base (275)..(275): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcngagtgctgcctnttgtcgccccacgagctagaagcgaagacgacccctaccaaaaccttcctactactctaagtacggtaaaacccagactaaacgtcccgggaccccttaacggaaccgggggttcccctcgggtaaacccgtatttcccgtccgtacgggaccctttacccaaacggttccgttacgggaccctaacccgttcccaacgggttacccccttaccccggttcgggtaccctaacgtccggtccggttacggggtccccgttacccggggtaagggggtttacggaaccggtaaggttaccgggaagggttccttacggtttaaacttttaactttaaacgtttcggacccctaaggttaaccccttaattacggtaacccttaaaccgttaaccccgttcggtttccgggttttgggttttttcgggtccgtttcgggggtttcccgggacccgggggtaccgggttaacccgtaaccggttcccggttaaccccggg

SEQ ID NO: 401465 - DNA, 640 bp, Homo sapiens
  misc_feature: GZ8MTXP01DFVN9.21.25.C03.1.454.CMB.2.raw
  modified_base (270)..(270): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtgaggaggagaggagaccgaggccagtgcgtggagtattgtccngagtgctgccttcttgtcgccccagagctgaacgcaagacgacccctaccaaactcctactaacttctagtacggtaaaccacgactaacgtcccggtcccctaacgggaccgggggtccctaggtaacccgtatttccgtcgtcgggccttaccgtaacgtcgtacggccaccctccaccgtcccttcccgtggtcacgtccgcgtcgggccttccgggacggtcgtcgacgagtcgagtcgtagttatttattagtcgtcctaacgttccttagtacgaaacctaaccgtaccgttcggttccggttttgggttttcggtcggttcgggtttccgggcggggttaccgggaaccgttaacggtcccgg

SEQ ID NO: 401466 - DNA, 653 bp, Homo sapiens
  misc_feature: GZ8MTXP01AWNPZ.21.25.C03.1.454.CMB.2.raw
  modified_base (262)..(262): a, c, t, g, unknown or other
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctgggccccagacaccgagggcggctgcgtcagcacagactgggcccaggaccctgtgcagtgagcgaggagagtgaggaggagaggagaccgaggccatgctggagattgtcngagtgctgcctnttgcgcccangctgaagcagacgtccctacccgaaactcctacattcctaagtcggtaaaacccaggactaaacgtcccggggccccttaacggacccgggggttcccctaggaacccgttatttccgtcgttcgggcccttacccgaacgttccgtacgggacctaaccccttccgaacgtccccgttccccgttggtccacgtccgcgttcgggccttcgggacggtcgtaggacgtagtgacggttacgttagttaattagttacgtcgtccgtaacgttacttacgtaccgaaaccgtaacccgtccgttcggtttcggtttcgggtttcggtcggttcgggttccgggcgggttaccggtaaccgaacggtccg

SEQ ID NO: 401467 - DNA, 664 bp, Homo sapiens
  misc_feature: GZ8MTXP01A4WI3.21.25.C03.1.454.CMB.2.raw
  modified_base (266)..(266): a, c, t, g, unknown or other
  modified_base (289)..(289): a, c, t, g, unknown or other
  modified_base (336)..(336): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccctggggccccagacaccggagggcggctgcgtcagcacagactgggcccaggaccctgtgcagtgagcgaggagagtgaggaggagaggagaccaggccatgctggagattgtccngagtgctgcctcttgtcgcccanagctgaagcagacgccctacccaaactcctcatctatcggtaaaccnggacaacgtcccggcccctacgaccggggtccctgacccgtattccgtctcgggcctaccaacgtcgtcggccaccgtccacgtccctcccgttcggtccacgttccgcgtcggggtccctaccgggtacgggtccgttacggaaccggtaagttccggaaggtcgttaggttaacttttaagtttaacgttcggtacccgtaacggttacccttaagttaccggttaaacctaaacccgtacccgttcgggttcggttttcgggtttttcgggtcgtttcgggtttcccggggccggggttaccgggtaaccgttaacggttcccgg

SEQ ID NO: 401468 - DNA, 879 bp, Homo sapiens
  misc_feature: GZ8MTXP01CC3TQ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactcggggcccaggaccctgtgcagtgagcgaggagagtggaggaggagaggacgaccgaggccagtgcgtaggagtagttcgtccgtggaggtcgtccgttcggtcccttccgtttggtccgaccccaaacgtacggtaccgtaaggaaacggaccgaaacggacccggtaccccccttaaacccgtaaaaacccttcccctaacttaacgttaccgttaaacgtaacggggtaaaaccccacgggtacctaaaccggtcccgggtacccccgttaacgggtaaccccgggggttcccctacgggtaaacccgttactttcccgtccggttacggggtacccttaacccgtaaacggttcccggtaccggtacccctacccttacccgaccggttacccccgttccccggttacgggtacccctacggttcccgggtaccggttaccgggggccccttaccggggtacggggtccgttaacgggaaccggtaacgttgggaaacggttcgttaaggttaacttttaacgtttacgttccgtacccgttaacgttacccgttaataacccggttaaacctaaacccgtccccggtttagggttccgggttttcggggtttttccgggtccggtttccggggtttccggggacccggggttaccggggtaacccgttaacggttccccggg

SEQ ID NO: 401469 - DNA, 662 bp, Homo sapiens
  misc_feature: GZ8MTXP01AHA6T.21.25.C03.1.454.CMB.2.raw
  modified_base (264)..(264): a, c, t, g, unknown or other
  modified_base (276)..(276): a, c, t, g, unknown or other
  modified_base (281)..(281): a, c, t, g, unknown or other
  modified_base (286)..(286): a, c, t, g, unknown or other
  modified_base (295)..(295): a, c, t, g, unknown or other
  modified_base (319)..(319): a, c, t, g, unknown or other
  modified_base (336)..(336): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagacgtgggcccaggaccctgtgcagtgagcgagagagtgaggaggagaggagaccaggcatgcgtggagattgtcngagtgctgcctntgtcncccangctagaacncaagacgccctaccaaactcctanatctagtaggtaaaccnggacaacgtcccggaccctacgggaaccggggttccctacggtaacccgttatttcccgtcgtcgggtacccttacccgtaacgttccgtcggacctaccctaccgaccgtccccgtcccgtcggtcacgttccgcgtcggggtccctacgggacggtcgtaggaccgtagtcggacggtcttaggttaattttacgttacgttccgaccgttaacgtccttacgtaacgaaccctaaacccggtacccgttcgggttcggttttcgggttttcgggcgttcgggttcccggggtaccgggttaccgggtaaccgaacggtccccg

SEQ ID NO: 401470 - DNA, 719 bp, Homo sapiens
  misc_feature: GZ8MTXP01ATSJ7.21.25.C03.1.454.CMB.2.raw
  modified_base (296)..(296): a, c, t, g, unknown or other
  modified_base (345)..(345): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactggggcccaggaccctgtgcagtgagcgaggagagtggaggaggagagggacgaccaggccagtgcgtgggagtattgtcctggagtgctgccttctgtcgcccanagctagaacgcagacgccctaccaaactcctacatctagtagtaaaccngacaacgtcccggaccctacggaaccgggggttcccctaggtaaccccggtatttcccgtcgtcgggacccttacccgtaaagttccgtacgggtaccctacccgttaccgaccgtccccgttcccgttcgggtcctaaccgtccggtacgtccggggtcccttaccggaacggggtcgttacggaaccggtagtgggtaacgggtcttaaggtacttttaaagttacgtttcggacccttaacggttccccttaagtttaaccgaaacctaaacccgtcccgtttcgggttccggtttttcggggttttccgggtccggtttcgggttcccgggggccgggttacccggggtaaccgttaacgggttccccgg

SEQ ID NO: 401471 - DNA, 621 bp, Homo sapiens
  misc_feature: GZ8MTXP01AKPO6.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggcccccagacaccgagggcggctgcgtcagcacagactgggcccaggaccctgtgcagtgagcgaggagagtgaggaggagaggagaccaggccatgctggagtattgtcctgagtgctgcctctgtcgccccacagctagaagcagacgcctaccaaactcctacatactagtacggtaaaccagcaaacgtccggcccctacgaacgggggtcccctaggaccccgtattccgtcctggcctaccaagttcctggccaaccctcgaactcccgtccctggtaccacgttccgcgtcgggccttccgggacggtctgaccgtatggacggtcgttagtaatttattaattcggaccctaacggttacccttagtaccggaaacctaaccgtaaccccgttggttccggtttggggtttttcggcgtttcggttccgggcgggttccgggaaccgttaacggtcccgg

SEQ ID NO: 401472 - DNA, 742 bp, Homo sapiens
  misc_feature: GZ8MTXP01CM344.21.25.C03.1.454.CMB.2.raw
  modified_base (293)..(293): a, c, t, g, unknown or other
  modified_base (348)..(348): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtcgggcccaggaccctgtgcagtgagcgaggagagtgaggaggagaggagaccgaggccatgcgtggagtagttgcctggagtgctgcctcttgtcgccccanagctaggaagcaagacgccctacccaaaactcctacatctaagtaggtaaacccngacaagtcccggaccctaacggacggggttcccctagtaacccgtattcccgtacgtcgggtaccttacccgaaacgttccgtcggtaccctaccctaccgtacccgtccccttaccccgtgggtaccctacgtccggtcgttccggggtcccttaccgggaacggtcccgttcggaaccggtaagttcggaccgggtctttacggttaaattttaacgttttacgttacgtacccgttaacgttaccgttaagtaccggttaaaccctaaaacccggttaccccgtttcgggttttccgggtttacggggtttttttaaccgggccggttttcggggttacccgggggttacccggggacccggggtaacccgttaaaacggtttccccgggg

SEQ ID NO: 401473 - DNA, 613 bp, Homo sapiens
  misc_feature: GZ8MTXP01CBVK4.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtgaggaggagaggagaccaggccatgctggagtattgtcctgagtgctgcctcttgtcgcccanagctagaacgcaagacgaccctacccaaaacttcctactattactaagtacggtaaacccaggactaaacgtcccggaccctacggaaccggggttccctagaacccggtatttccgtcgtcggcctaccgaagtcgtcggcctaccgtcacgtcccttcccgtgtcacgtcgtctcggggcctcggggacggtcgtacgacgagtggaacgtctaggtattaagttattcgacgtaacgtacttatacgacctaaaccgtcccgttggttcggtttggttttcgcgttcggttcgggcgggaccggtaacgttaacggtccg

SEQ ID NO: 401474 - DNA, 512 bp, Homo sapiens
  misc_feature: GZ8MTXP01EA63N.21.25.C03.1.454.CMB.2.raw
  modified_base (272)..(272): a, c, t, g, unknown or other
  modified_base (282)..(282): a, c, t, g, unknown or other
  modified_base (324)..(324): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctcctntgtcgcccanagctgaagcagagcctaccaaactcctacatctatggtaacncgacaagtccggccctcgaacggggtccctggaccgtattctctggctcaagtctgccactcacgccctcccgtgtcagtcgctcgggctccgaggggtctggacgtagtggagctagtattattatcgctagtctattgaacttacactgttcgttggtttgtcgtgtcggcggcggacaagcgtcg

SEQ ID NO: 401475 - DNA, 630 bp, Homo sapiens
  misc_feature: GZ8MTXP01BBF7Y.21.25.C03.1.454.CMB.2.raw
  modified_base (265)..(265): a, c, t, g, unknown or other
  modified_base (287)..(287): a, c, t, g, unknown or other
  modified_base (295)..(295): a, c, t, g, unknown or other
  modified_base (301)..(301): a, c, t, g, unknown or other
  modified_base (317)..(317): a, c, t, g, unknown or other
  modified_base (365)..(365): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccatgcgtggagtattgcngagtgctgcctcttgcgcccangctagaancagacncctaccaaactcctanatctagtacggtaaaccagacaacgtccggccctagaccggggtcccngaacctattcctcgtcggcctacgagtcgtcggccacctcacgtccctccgtggtcacttcgcgtcgggtacctccggggacgtcgtacgacggtagtcggtaacggtcgttagtaagttttacttaacgtttcgtcccgtaacgttcccttaaacgttaccggaaaccctaaaccgttccccgttgggttccggttttcggggttttcggccggtttcgggttaccgggggcgggttacccggggtaacgttaacgggtcccgg

SEQ ID NO: 401476 - DNA, 685 bp, Homo sapiens
  misc_feature: GZ8MTXP01EC40Q.21.25.C03.1.454.CMB.2.raw
  modified_base (262)..(262): a, c, t, g, unknown or other
  modified_base (274)..(274): a, c, t, g, unknown or other
  modified_base (284)..(284): a, c, t, g, unknown or other
  modified_base (319)..(319): a, c, t, g, unknown or other
  modified_base (337)..(337): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagtattgtcngagtgctgcctnttgcgcccanagctagaagcaagacgaccctacccaaactcctanatactagtacggtaaacncggtacaacgtccggaccctacggacgggtccctagacccgtattccgtacgtcgggcctaccgaacgttcgtcggaccaccgtccaccgtccccgttcccgtcggtccacgtccgtcgtcggggtccctacggggtacggtccgttacggaaaccgtagtcggtaacggtccgttaaggttactttaagtttacgtttcgcccgtaacgttccttaacgtaaccggttaaaccctaaacccgtaacccggtttcgggttcgggtttttcggggtttttcgggtcgtttcggggttcccggggaccggggttaccgggtaaacccgttcggttaaaaaaaaaacccgg

SEQ ID NO: 401477 - DNA, 625 bp, Homo sapiens
  misc_feature: GZ8MTXP01EJ057.21.25.C03.1.454.CMB.2.raw
  modified_base (531)..(531): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctggccctggggccccagacaccgagggcgctgcgtcagcacagactggggcccaggccctgtgcagtgagcgaggagagtgaggaggagaggagaccggaggcctagtgcgtggagtattgtaccgtggagtgctgtcctcgtttcgcgaccccagacggactaggaacgcaacgacgtacccctaccctaaaacctcctatactctaaagtcggtaaaccagactaaacgtcccggaccccgtcggtaaccggggttcccctagtaacccgtactttccgtaccgtcgggtaccttaccgaacgttcgtacggacctaccgtcacgtcccttccgtgtcacgttcgcgtcggcctacgggacgtcgtacgacgtagtggacggtnttagtatttaattctcgtcctaagtccttagacgaactaacctcgttggttcgtttggtttgcgttgggttaccggcggacggtccgaagtccg

SEQ ID NO: 401478 - DNA, 694 bp, Homo sapiens
  misc_feature: GZ8MTXP01DS7WZ.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgccccanagctagaacgcagacgccctacccaaaactcctacaacttctaagtcggtaaaccagacaaagtcccggcccctaacggacgggggttccctaggacccgtatttccctacgtcgggccttacccgaacgttccgtacgggtaccctacccgtacgacccgttccccgttccgttacgggtcctaccgttccgggtccggttacgggtccccttaacgggggacgggtcgttaacgggaaccgtaggttagggaccggttacgttaggtttaactttaagtttacttcggtaccttaacgttacttactaccgttaaacctaacccgtcccgttcgggtttcggttttgggtttccggtcggttcggggttcggggccggggttacgggaaccgttaacggtcccgg

SEQ ID NO: 401479 - DNA, 694 bp, Homo sapiens
  misc_feature: GZ8MTXP01DMV0D.21.25.C03.1.454.CMB.2.raw
  modified_base (286)..(286): a, c, t, g, unknown or other
  modified_base (316)..(316): a, c, t, g, unknown or other
  modified_base (332)..(332): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagagttgctgagtgctgcctcttgtcgcccangctagaagcagacgcctaccaaactcctanatctatacggtaaccngacaagtccggcccgtacgacggggtccctgacccgtatttccgtcgtcgggtacctacccgtaacgttctacgggcctaccctccgtaacccggtccccttccccgttcggtacccacgttccggtcggtccggggtccttacccggggaacgggtccgttacgggaacggtacgttagggtacgggtcgttaggttacttttaagtttacgttccgtaccgttaacgttcccgttaacgtacgaaacccgtaaaccgtccccgttacgggtttccgggttttcggggttttttcgggtccggtttcggggtttacccggggcggggttacccgggggtaacccgttaacgggttcccggg

SEQ ID NO: 401480 - DNA, 636 bp, Homo sapiens
  misc_feature: GZ8MTXP01EUOLN.21.25.C03.1.454.CMB.2.raw
  modified_base (263)..(263): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtcngagtgctgcctcttgcgcccanagctgaagcagacgccctacccaaactcctacatctagtacggtaaacccagaccaaagtcccggcccctaacggacgggggttcccctagggaacccgtatttcctcgtcgggaccttaccgtaacgttcgtcgggtacccacccgttaccgaccgtccccgttcccgttagggtcctacgtccggccgttcggggtccttcccgggaagggtcctaggaccgtagtaggacggtcttaggtaactttattagttcgacctaagtccttatacgacctaaaccgtccgttgttccggtttggttttcgcgttcggttacgggcgggttaccggtaaccgttaaggtcccg

SEQ ID NO: 401481 - DNA, 813 bp, Homo sapiens
  misc_feature: GZ8MTXP01BKMZO.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgcgtggagtattgctgagtgctgcctctgtcgcccanagctagaacgcagacgcccctacccaaaccttccctactacttacgttaaagttacgggtaaaacccacggaccaaacgttccccgggacccccttaaccgggaaccggggggttccccctagggtaaaccccggttattttcccgtaccgttcggggtaccccttaacccgtaaacggttcccgttaccgggcccctaaacccccgtttcccgaacccggttcccccctttacccccggttacggggttcccctaacccggtttcccgggcccgggttccgggggtaccccttccccgggggtaacggggcccgttaccgggaaacccgggttaacgttggggaacggtcccgtttaaggtaaactttttaaagtttaacgtttccgaaccccgtaacggttaccccgttaaatacccggaaaccctaaaaccccgttccccggtttgggttcccgggttttggggtttttcgggcggtttcgggttcccgggggccggggaccgggtaacccgaacggtccccgg

SEQ ID NO: 401482 - DNA, 797 bp, Homo sapiens
  misc_feature: GZ8MTXP01CLECR.21.25.C03.1.454.CMB.2.raw
  modified_base (463)..(463): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtcgggcccaggaccctgtgcagtgagcgaggagagtgaggaggagaggagaccgaggccagtgcgtaggagtagttcggtccgtaggagtcgtcgtcgtcccttcgtttcggccgacccccaagtacggtactaaggaacgccgaacggacccgtacccctaaccctaaaacctccctactattacgtaacgttacgggaaaaccccaggtacctaaacggtccccggtccccgtaaacgggtacccgggggtcccctagggtaaacccgttntttccgtccgtccgggtacctaccgtaacgttccgtacggtaccctaacccgtccgacccgtccccgttcccggttcggtaccgtaccgtccgggtaccggtccgggtcccgtaccggggtaacgggtccgtacgggaccggtagtcggtaacggtcgttaagttactttaacgttcgttccgaccgttaacgttacgttaactaccggttaaccctaaacccgttcccggttacgggtttccgggttttacgggtttttccgggtaccggtttccgggggtttaccggggacccggggttaacccgggtaaccgttaacgggttaaccccggg

SEQ ID NO: 401483 - DNA, 641 bp, Homo sapiens
  misc_feature: GZ8MTXP01A3KXC.21.25.C03.1.454.CMB.2.raw
  modified_base (461)..(461): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgccctggggccccagacaccggagggcggctgcgtcagcacagacgtcgggcccaggaccctgtgcagtgagcgaggagagtgaggaggagaggagacaggccatgcgtggagtattgtccgtggagtgctcgccttcgttgtcgcccagagctagaagcaagacgtccctaacccaaactcctactatactaagtacggtaaaccaggacaacgtcccggccctacggaccggggtccctaggacccgtattccgtcgtcgggtcctaccgtaacgtccgtcggacctacctcgaccgtccctccgtggtaccncgtcgcgtcggtcctcggggacgtcgtacgacgagtcggtacgtacttagttatttacttacgttccgtaccgtaacgttaccttacgtaccgaaccgtaccgtaccgttcggtttcgggtttcgggttttcggtcggttcgggttccggggccgggttaccgggtaacgttaacggtcg

SEQ ID NO: 401484 - DNA, 725 bp, Homo sapiens
  misc_feature: GZ8MTXP01CW2U1.21.25.C03.1.454.CMB.2.raw
  modified_base (293)..(293): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagtattgtccgtgagtgctgccttcgttgtcgccccangctagaacgcagacgccctacccaaactcctacacttctatacgttaaaccagtacaacgtccggcccctacggacggggttcccctaggacccgtatttcccgacgtcggtaccctaccgtaacgttcgtccggtaccctacccgtaccgtacccgtcccctttccccggttacggtacccgttacgttcccggtcgggttccggggtccccttaccgggggtacgggtccgttaccggaacggttacggtacgggtacggttacgttagttaattttacgtttaacgttcccgtaaccgttaaccgttccttaaacgtaccgaaacccgttaacccgtacccgtttcgggtttcgggttttcggggtttttcggtccggttccggggttcccggggaccggggttacccgggtaaccgcggttaacccgg

SEQ ID NO: 401485 - DNA, 708 bp, Homo sapiens
  misc_feature: GZ8MTXP01CFRB5.21.25.C03.1.454.CMB.2.raw
  modified_base (262)..(262): a, c, t, g, unknown or other
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggatattgtcngagtgctgcctnttgtcgccanagctagaagcagacgtccctaccaaactcctacattacgtatacggtaaacccacggacaaacgtcccgggaccccttaacggaaccgggggttcccctagggtaaccccgttactttccgtaccgtcgggaccttacccgtaagttcccgtacggtacccacccgttccgacccggtccccttccccgtcgggttaccctacgttcccggtccgttcgggggcccttacccggggaagggtccgttacggaaccggtacgttgggacggtaccgttaggttaacttttaacgttacgttacgtacccgtaacggttaccttacgtacgaaacccgaaaccgttaccccgttgggttccggttttcgggttttcggcgttcggggttccgggcgggttaccgggaacccgttaacggtaacccg

SEQ ID NO: 401486 - DNA, 838 bp, Homo sapiens
  misc_feature: GZ8MTXP01DZ1DI.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactgggcccaggaccctgtgcagtgagcgaggagagtgaggaggagaggagacaggccatgcgtggagtattgtccgtgagtcgtccgtcgtcccttcgttcggtcgacccccacgacggccgtaggaaacgcgaagtaccgtacccctaaccctaaaaccttccctactaacttctaaagttacggtaaacccacggtaccaaacggttccccggccccgttaacccgggaacccgggggtttcccctacgggtaaacccgttacgtttccgtccggtacggggtaccctttacccgtaaacggttccgtacgggtacccctaacccgttccgtacccggttcccccgttcccgttcgggttaccctacgtcccgtccggtcggggtcccttcccggggaacgggtccgtacggtaaaccgggtagttcgggtaaacggggtcctttaaggtttaaattttacgttttacgttacccggaccctttaaaccgggttacccttaagtaacccggttaaacccttaaaacccggttccccggtttcgggtttcggggtttttcggggttttttccgggtccggttttcgggggtttcccgggggacccgggggttaccgggtaaacccggttaacggggttaaccccggg

SEQ ID NO: 401487 - DNA, 516 bp, Homo sapiens
  misc_feature: GZ8MTXP01CB7XV.21.25.C03.1.454.CMB.2.raw
  modified_base (490)..(490): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgagagagtgaggaggagaggagaccaggccatgctggagatgtcctgagtgctgcctcttgtgcccacagctgaagcagacgcctaccaaaactcctacatcctaatggtaaaccagcaaatccggccctcaacgggggtccctgaacccgattcctctggctcccaagtctggcacctcagcctccctggtcagtcgctgggcttccgaggctgacgatgaggctgtattatattcgccaagtccttatgaccaacacccttgcgttggtttgntggttcgcggttcggaaccaagtccg

SEQ ID NO: 401488 - DNA, 563 bp, Homo sapiens
  misc_feature: GZ8MTXP01AD7D0.21.25.C03.1.454.CMB.2.raw
  modified_base (262)..(262): a, c, t, g, unknown or other
  modified_base (284)..(284): a, c, t, g, unknown or other
  modified_base (315)..(315): a, c, t, g, unknown or other
  modified_base (332)..(332): a, c, t, g, unknown or other
  modified_base (497)..(497): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcngagtgctgcctctgtcgcccanagctagaagcagacgcctaccaaacttccanatctagtcggtaaaccnggacaacgtcccggcccctacggacgggggttcccctggaacccgtatttccgtcgttggcctaccaagtctcggcacctcacgcccctcccgtggtccacgtccgcgtcgggcctccggaggctgacgatggagctagtatttattattcgcctaagtccttancgaacctaaccgtcccttggttcgtttggttttggcgttggttcgggcggcggtaaccgaagtccg

SEQ ID NO: 401489 - DNA, 639 bp, Homo sapiens
  misc_feature: GZ8MTXP01BHSP1.21.25.C03.1.454.CMB.2.raw
  modified_base (262)..(262): a, c, t, g, unknown or other
  modified_base (274)..(274): a, c, t, g, unknown or other
  modified_base (283)..(283): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctgggccccagacaccgagggcggctgcgtcagcacagactgggcccaggaccctgtgcagtgagcgaggagagtgaggaggagaggagaccaggccatgctggagattgtccngagtgctgcctntgcgcccanagctgaacgcagacgccctaccaaactcctacattctaagtcggtaaaccaggacaacgtcccggccctacggacggggttcccctggaacccgtatttcctaccgtcgggacccttaccgtaacgttccgtacggaccctaacccgttccgaccgttcccccttccgttcggtcctacgtccgcggtcgggcctccggggacggtctacggacgtagtggacgtcgtagtatttattacgttcgccgtaacgttccttaagtacgaaaccctaaaccgtcccgttaggttcgggttttgggttttcggcgttcgggttccggggccggggttaccgggtaaccgttaaggtcccg

SEQ ID NO: 401490 - DNA, 795 bp, Homo sapiens
  misc_feature: GZ8MTXP01EK7ZE.21.25.C03.1.454.CMB.2.raw
  modified_base (654)..(654): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtgggcccaggacctgtgcagtgagcgaggagagtggaggaggagaggagaccgaggccagtgcgtggagtagttgtcctggagtcggctcgtccttacgttgccgcccccaagaggtacctagggaaacgccgaaaggtaccctacccccttaaccccaaaacctttccctacaacttacgttaacgtaacgggtaaaaccacggtactaaacgtccccggggaccccgttaaaccgggtacccgggggtttcccctacgggtaaaccccgggttacttttccccgttccggttacggggtacccctttaacccgtaaacggttcccgttacgggacccctaaccccgtttacccgacccggttccccccgtttaccccggtttaccgggttaccctacgttcccgggtccggtcggggtaccctaccgggggtaacggtcgttacgacgtagtcggacggtntaggttatttagtttacgttcgacctaacgttaccttagtaccgttaccgtaaacctccgttcggttcggttttcggggttttcggtcggttcggggttcccgggtacgggggttaccgggtaacccgaaggttccccggg

SEQ ID NO: 401491 - DNA, 630 bp, Homo sapiens
  misc_feature: GZ8MTXP01A0L3T.21.25.C03.1.454.CMB.2.raw
  modified_base (262)..(262): a, c, t, g, unknown or other
  modified_base (274)..(274): a, c, t, g, unknown or other
  modified_base (278)..(278): a, c, t, g, unknown or other
  modified_base (285)..(285): a, c, t, g, unknown or other
  modified_base (336)..(336): a, c, t, g, unknown or other
  modified_base (378)..(378): a, c, t, g, unknown or other
  modified_base (433)..(433): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcngagtgctgcctnttgngccccanagctagaagcagacgccctaccaaactcctacatccgtatacggtaaaccngcaaagtccggccctacgacggggtccctagacccgtattcncgttggcttacccaagttctacggccacctcgacgtccctccccgttggtacccncgtcgtcgtacgggtcctccggggtacggtcgtacggacggtacgtcggacggtcgttagttaactttagtttacgtccgtaccgtaacgttccttaagtaccgaaaccctaacccgtaccgttcggtttcggttttcgggttttcggtcggtttcgggttaccgggccgggttaccggtaaccggaaccgtaacgg

SEQ ID NO: 401492 - DNA, 821 bp, Homo sapiens
  misc_feature: GZ8MTXP01BJCAE.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtgggcccaggaccctgtgcagtgagcgaggagagtggaggaggagaggagaccaggccatgctggagtattgctggagtgctgccttcgttgtccgcccaagcgctaggaaacgcgaaagaccgtaccccttaccccaaaacttccctactaacttaccgttaagtacggggtaaaccacggtactaaaccggttcccgggacccccttaacgggaaccgggggtttccccacgggtaaacccggttactttccccgtcggttcgggccctttaaacccgaacggtttccgacgggtacccctaacccgttccgaacccggtcccccgttaccccggttgggtaccctaaccgttcccgggtaccggttaccggggggtccccttacccggggaacggggttcccgttacgggaaacccggttaacgaggggtaacgggttacccttaagggtttaacttttaaacggttttcgttacccgggtaacctaaccggtttaaccttaacggtacccgttaaaccctaaacccggtccccgtttgggttcccgggtttttggggttttccggcggtttccggggttcccgggggaccgggttacccgggtaacccgttaacgggttaacccggg

SEQ ID NO: 401493 - DNA, 786 bp, Homo sapiens
  misc_feature: GZ8MTXP01ENRCC.21.25.C03.1.454.CMB.2.raw
  modified_base (266)..(266): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcggggcccaggaccctgtgcagtgagcgaggagagtgaggaggagaggagacgaggccatgctggagattgtccngagtgctgccttcttgtcgccccacagctaggaacgcaaggacgtacccctaccctaaaaccttccctactaacttacgtaagttacgggttaaaacccacggaccgaaaccgttcccgggaccccccttaacgggaacccggggggtttccccctaagggtaaaccccggttacttttcccgttcccggttcggggtacccctttacccgtaaacgttccgttacgggaccctacccgttccgacccgttcccccgttccccgttcgggtcctaacgttccggccgttcggggtcccttaccggggaacggtccggtacggtaaccggtagtcggacgggtaccttaggttaattttactttaacgtttccggacctaacggtttacccttaagtaccggttaaacctaaacccgtaacccgttcggggtttcgggttttccggggttttttcggggtccggtttcggggtttcccgggggacgggggttacccgggaacccgttaagggttccccggg

SEQ ID NO: 401494 - DNA, 689 bp, Homo sapiens
  misc_feature: GZ8MTXP01C4LKZ.21.25.C03.1.454.CMB.2.raw
  modified_base (262)..(262): a, c, t, g, unknown or other
  modified_base (274)..(274): a, c, t, g, unknown or other
  modified_base (277)..(277): a, c, t, g, unknown or other
  modified_base (282)..(282): a, c, t, g, unknown or other
  modified_base (290)..(290): a, c, t, g, unknown or other
  modified_base (313)..(313): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctggagtattgtcngagtgctgcctntgncccanagctgaancaagacgcctacccaaactcctnattctatacggtaaaccaggacaaagtccggacccctacggaaccggggtcccctagacccgtatttcctcgtcggacctacccaagttcctcggacctacctcacgtccctcccgtcggtcacgtccgtcgtcgggccttaccgggcggtaccgttacggaccgtagtcggtaacgggtcgttaaggttaatttaacgtttaacgttccggtaacccgtaacggtttaccccttaaagttaccggaaaccctaaacccgttaaccccggtttcgggtttccgggttttcgggggtttttttcgggccggttttccggggttccccgggggtcgggggttacccgggggtaacccggttaaacggttaaccccggg

SEQ ID NO: 401495 - DNA, 668 bp, Homo sapiens
  misc_feature: GZ8MTXP01CD0GY.21.25.C03.1.454.CMB.2.raw
  modified_base (338)..(338): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggcatgctggagattgtcctggagtgctcgccttcttggtcgcccacagctgaagcagacgccctaccaaactcctcatctatacggtaaaccngacaacgtccggcccctaacggacggggtccctagacccgtattccgtcgtcgggtacctaccgtaacgttccgtcgggtaccctacccgtaccgtacccgtcccccgtttcccgttcgggtcctacgttccggtcggtcggggtcccgttcccgggagggtccgtacggaacggtagttcggaacggtcgttaggttattttaacgtttacgttcggacctaacgttccttaacgtacgaaacctaaaccgtccgttacggttccggttttgggtttttcggcgtttcgggttccggggcgggttaccgggtaacgttaacggtcccgg

SEQ ID NO: 401496 - DNA, 612 bp, Homo sapiens
  misc_feature: GZ8MTXP01C1I3N.21.25.C03.1.454.CMB.2.raw
  modified_base (582)..(582): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagacgtcgggcccaggaccctgtgcagtgagcgaggagagtgaggaggagaggagacaggccatgcgtggagtattgtcctgagtgctgtccttgttgcgccccagagcctaggaacgccaagaccgcccctaacccaaaactcctacaagttcctaagtacggtaaacccagactaacgtcccggccctaacgggtaacggggtcccctaggtacccgtatttccgcgtcggtccctaccgtaagttccgtacggccctaaccgtccgaccgtcccttcccgttggtaccacgttccgccgtcgggcctcggacggtcgtagacgtagtggacgtgttagtacttatatcgactaagtccttatcgaactaacctcgttagttcgttggtttcgngttcggtcgggcgacggtaacgaaggtccg

SEQ ID NO: 401497 - DNA, 758 bp, Homo sapiens
  misc_feature: GZ8MTXP01E4NOU.21.25.C03.1.454.CMB.2.raw
  modified_base (276)..(276): a, c, t, g, unknown or other
  modified_base (287)..(287): a, c, t, g, unknown or other
  modified_base (321)..(321): a, c, t, g, unknown or other
  modified_base (341)..(341): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgccttntgtcgccccanagctagaagcaagacgcccctaccaaactcctanattcctaagtcggtaaaccnggacaacgtccggcccctaacgggacggggtccctgacccgtatttccgtcgtcgggcctacctaagtccgtacgggcctacccgtccgaccgtccccttcccgttcggtccacgtcccggtaccggtcggggtccccttacccggggaacggggtccgttacgggaaaccggtacgttagggaaacgggttccgttaaggttaaattttaagttttaacgttaccgggtaccctaacgggtttacccctttaaagttaacccggttaaaccctaaaaccccgttaaccccggtttcggggtttcccgggtttttacgggggttttttttccggggacccggtttttccgggggtttccccggggggacccggggttaccccgggggtaaaccccggttaaacgggtttcccccggg

SEQ ID NO: 401498 - DNA, 621 bp, Homo sapiens
  misc_feature: GZ8MTXP01B7XGU.21.25.C03.1.454.CMB.2.raw
  modified_base (279)..(279): a, c, t, g, unknown or other
  modified_base (284)..(284): a, c, t, g, unknown or other
  modified_base (289)..(289): a, c, t, g, unknown or other
  modified_base (336)..(336): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtgaggaggagaggagaccaggccagtgctggatattgtctgagtgctgcctntgtcncccangctagacgcagacgcctacaaactctacactctagtacggtaaaccncgacaacgtcccggcccttaacgggaccgggttccctagacccgttacttccgtcgtcggtacctacgtaacgtctacggacctaccgtcacgtccccttcccgtggtccacgtccgtcgttcgggccccttacggggacggtcgtacggacgtaagtgacggtcttagtactttagttactcgctaacgtcttagtacacctaaacgtcccgttggttcggtttcgggttttcgcggtttaacgggttccgggaccgggttaccggtaaccgttaacggtcccg

SEQ ID NO: 401499 - DNA, 614 bp, Homo sapiens
  misc_feature: GZ8MTXP01EJM7W.21.25.C03.1.454.CMB.2.raw
  modified_base (277)..(277): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtcgcctccctnttgtcgcccanagctgaagcagacgccctaccaaaccttcctacagttctaatacggtaaacacgactaaacgtcccggccctccggaaacgggggttcccctggaacccgtatttccgtccgtgggtcctccgtaaagtccgtcggccaccctcaccgtcccttcccgtcggtccacgtccgcgtgggtcctcccgaggggtctacggacgagtggacggtcttagtatttattattgcctaagtcctagttcgaaccttaaccgtaccgtgttccggtttggttttcggtcgttcggttccgggtcgggccgggaccgtaacgttcgtaacccgg

SEQ ID NO: 401500 - DNA, 683 bp, Homo sapiens
  misc_feature: GZ8MTXP01E423H.21.25.C03.1.454.CMB.2.raw
  modified_base (293)..(293): a, c, t, g, unknown or other
  modified_base (308)..(308): a, c, t, g, unknown or other
  modified_base (324)..(324): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgcgtggagattgtcctggagtgctcgccttcttcgtcgccccanagctagaagcagacnccctacaaactcctanatctagtaggtaaaccagacaagtcccggccctaacggacggggtcccctaggacccgtattccgtctcgggcctacccgtaagtcgtacggaccacctccgacgtaccccttcccgtggtaccacgttccgcgtacggggtcccttacccggggaacggtcgtacggaaccggtagtcgggaacgggtctaggttaaactttaagtttaacgttccgaccgtaacggtccccttaagtaccggttaaaccctaaaacccgtcccgttcgggttccggttttcggggtttttcgggccggtttaacggggttccggggaccggggttacccggggttaacccgaacggttaaccccggg

SEQ ID NO: 401501 - DNA, 641 bp, Homo sapiens
  misc_feature: GZ8MTXP01BRQQI.21.25.C03.1.454.CMB.2.raw
  modified_base (337)..(337): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgctggagattgtctgagtgctgcctcttgtcgcccagagctagaacgcagacgccctacccaaactcctacatctagtcggtaaaccngacaacgtcccggcccgtacgacggggtccctagacccgtattccgtcgtcggcctacccgtaagtccgtcggaccctacctccgaccgtccccgttccccgtggtccacgtccgcgtcgggcccttccgggacggtcgtacggaccgtagtcggaggtcgttagtaactttagttacgttcgtccctaacgttaccttaagtccgaaccctaaacccgtcccgttacggttccggttttgggttttcggtccgttcgggtttccggggaccggggttacccgggtaaccgttaacggtcccgg

SEQ ID NO: 401502 - DNA, 723 bp, Homo sapiens
  misc_feature: GZ8MTXP01BBPQL.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccatgcgtggagtattgtcctgagtgctgccttcgttgtcgcccacagctagaagcaagacgtccctacccaaaactcctactatcttaagtacggtaaacccaggtacaaacgtcccggaaccccgtcggaacccgggggttccctacggtaacccgtacttttcccgccgttacgggaccccttaccgtaacgttcccgtcggggtacccctaaccccgttcccgaaccggttcccccgttccccggttcgggtacccgtacgttccggtccggtcggggtccctacccggggtacggggtccgttacggaaccggtagtcggtacggtccttaggttattttacgttagtttccgaccgttaagtcccttagtacgttaaaccgaacccgttaccccgttggttccggtttgggttttcggccgtttcggggttcccggggcgggttacccgggtaacgttaacggtaacccgg

SEQ ID NO: 401503 - DNA, 635 bp, Homo sapiens
  misc_feature: GZ8MTXP01DS9B8.21.25.C03.1.454.CMB.2.raw
  modified_base (291)..(291): a, c, t, g, unknown or other
  modified_base (322)..(322): a, c, t, g, unknown or other
tcagtcgtcgctcgcacgaccggtgctcgatttagtagtgtagatttgggtttgggggctgttcctggaagttgctgatgccagtgcacatcaaaaaggtgacccgatgttggagctgctcccagcgcaggagatggtgaccgtctgcccgtggggccccagacaccggagggcggctgcgtcagcacagacgtgggcccaggaccctgtgcagtgagcgaggagagtggaggaggagggagaccgaggccagtgctggagattgcgtgagtgctgccttctgtcgcccanagctagaagcagacgcctaccaaactcctanactctataggtaaaccacgacaaacgtcccggacccctacggaaccggggtccctagaacccgtactttcctcgtcgggtccttaccgaaagttccgtacggcctaccctcacggtcccttcccgtgggtaccagtccgcgtcgggccttcggaggctaggacgtagtgagtacttagtaatttattagttcgcgtaacgttaccttaagtcgaactaaacccgtacccgtttcgggttccgttttagggtttttcgggccgtttcggggtttccggggcggggttacccggggtaacccgttaacggtcccg

SEQ ID NO: 401504 - DNA, 670 bp, Homo sapiens
  misc_feature: GZ8MTXP01BBOCY.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtgggcccaggaccctgtgcagtgagcgaggagagtgaggaggagaggagaccaggccatgctggagattgtcctggagtgctgcctcgttgtcgcccanagctagaagcaagacgccctaccaaaccttcctactatactagtacggtaaacccaggacaaaggtcccggaccccttaccggaacgggggttccccctaggtaccccgtatttcccgtcgtaccgggcttacccgaacgttccgtcggccctacccgtccgaccgtccccgtccccgttgggtcctacgtccggtccgtcggggtaccttcccgggagggtccgtaggaccggtagtggaggtctagttaattagttaatccggctaacggttaccttagtaccgaacctaaccgtacccgttggttccgggttttggggttttccgggcgtttcggggttcggggcccgggttacggggtaaccgttaacggtcccgg

SEQ ID NO: 401505 - DNA, 674 bp, Homo sapiens
  misc_feature: GZ8MTXP01DJCGI.21.25.C03.1.454.CMB.2.raw
  modified_base (265)..(265): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggtcccagacaccggagggcggctgcgtcagcacagactgggcccaggaccctgtgcagtgagcgaggagagtgaggaggagaggagaccaggccatgctggagtattgtccngagtgctgcctcttgtcgcccanagctgaagcaagacgtccctaccaaacctcctacatctagtaggtaaacccagacaagtcccggaccccttacggacgggggttcccctaggaaacccggttatttcccgtacgttcgggtaccctaccgtaaacgttccgtacggccctacccgtcgaccgtccccgttccccgtcggtcctacgtccgtcgtcggggccctccgggacgggtctaggaacgtagtcggtaggtcgtagtaactttatttacgttcgtacctaacgttccgttaagtaccgaacctaaacccgtacccgttcgggttcggttttacgggtttttcgggacggtttcgggttccgggggccggggttacccggggtaaccgttaacgggttcccgg

SEQ ID NO: 401506 - DNA, 616 bp, Homo sapiens
  misc_feature: GZ8MTXP01BG67S.21.25.C03.1.454.CMB.2.raw
  modified_base (257)..(257): a, c, t, g, unknown or other
  modified_base (264)..(264): a, c, t, g, unknown or other
  modified_base (276)..(276): a, c, t, g, unknown or other
  modified_base (279)..(279): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccctggggcccccagacaccgagggcggctgcgtcagcacagactgggcccaggaccctgtgcagtgagcgaggagagtgaggaggagaggagaccaggccatgctgganattgtcngagtgctgcctntgngcccanagctgaagcagacgcctaccaaacttcctacatctagtacggtaaccaggcaagtccggcccctagacggggtccctagacccgattctctggctccaagtctggccacctccacgtcccctcccgtggtccagtcgtcgtcggggtcctcggggacggtctcggaacgtagtaggacggtcttaggtatttagttaacgttcggacccctaaggttcccttaaggtaccgaaccgaaacctaccccgttggttcccgggttttggggtttttccggcgtttcggggttcccgggggccgggttacccggggaaccgttaacgggtcccgg

SEQ ID NO: 401507 - DNA, 616 bp, Homo sapiens
  misc_feature: GZ8MTXP01ENJTT.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctcttgtcgcccacagctagaagcagacgcctacccaaaactcctacatctaatacggtaaaccaggacaacgtccggcccctacgacggggttccctagaacccgtattcctacgtcgggtcctacccgtaagtccgtcggccacctccacgtccctcccgtggtcactcgcgttcgggccttaccgggaggtcgtcgaacggagtacggaggtcgttaggtatttattagttcgccgtaacgttcccttaagtaccgaaactaaacccgtccccgttaggttccggtttgggtttttcggcgttcgggttcggggaccgggacggtaaccgaacggtcccgg

SEQ ID NO: 401508 - DNA, 601 bp, Homo sapiens
  misc_feature: GZ8MTXP01EZSCC.21.25.C03.1.454.CMB.2.raw
  modified_base (291)..(291): a, c, t, g, unknown or other
  modified_base (340)..(340): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccagtgcgtggagtattgtctgagtgctgccttcttgtcgcccacngctgaagcagacgccctacccaaactcctacatctagtacggtaaaccngacaagtcccggacccctaacggacgggggtccctacgaccgtatttcctcgtcggcctaccgaagtccgtcggcctacctcgacgtccccttcccgtggtcacgtccgcgttcgggcctccgggaggtcgtcgacgagtggacgtcgtagtatttagttattcgcctaagttccttatacgaacctaaccgtacccgttggttccggtttgggttttcgcgtttcgggttcgggccgggacgggtaaccgttaaggtccg

SEQ ID NO: 401509 - DNA, 563 bp, Homo sapiens
  misc_feature: GZ8MTXP01BPOQW.21.25.C03.1.454.CMB.2.raw
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggcccccagacaccgagggcggctgcgtcagcacagactgggcccaggaccctgtgcagtgagcgaggagagtgaggaggagaggagaccaggccatgctggagattgtctgagtgctgcctctgtgcccanagctagaagcagacgcctacccaaaacttcctacatcctaagtcggtaaacccagcaaagtccggcccctacgaacggggttcccctagacccgtattcctctagggcctaccaagtctggcacctcacgtccctccgtggtcacttcgcgtgggcctccggagcgtgaccgagtgaggtctagatttattatcgcctaagtccttagtagaccaacgtacccttggttcgtttggttttggccgttggttccgggcggttccgggaaccgaagtcccg

SEQ ID NO: 401510 - DNA, 570 bp, Homo sapiens
  misc_feature: GZ8MTXP01E4NSQ.21.25.C03.1.454.CMB.2.raw
  modified_base (246)..(246): a, c, t, g, unknown or other
  modified_base (251)..(251): a, c, t, g, unknown or other
  modified_base (337)..(337): a, c, t, g, unknown or other
  modified_base (473)..(473): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggagagaggagacaggcatgntgganattgtctgagtgctcgcctcttgcgaccccagagctagaaagcaagacgccctaccaaaactcctacatctaagtacggtaaaccncgacaacgtccgccctacgacggggtccctagaaccgtattcctcgtcggcctacgtaacgtctcggacctacctccacgtcccctccgtggtacagtcgcgtacgggcctaccgggagcgtagacgagtggagtntagtattatatcgctaacgtcttagtacaaccgtaaccgtcgttgttcggtttggtttcggcgttcgggtcgggacggttacggtaaccgaacgtcg

SEQ ID NO: 401511 - DNA, 637 bp, Homo sapiens
  misc_feature: GZ8MTXP01AK2TO.21.25.C03.1.454.CMB.2.raw
  modified_base (277)..(277): a, c, t, g, unknown or other
  modified_base (286)..(286): a, c, t, g, unknown or other
  modified_base (294)..(294): a, c, t, g, unknown or other
  modified_base (318)..(318): a, c, t, g, unknown or other
  modified_base (336)..(336): a, c, t, g, unknown or other
  modified_base (499)..(499): a, c, t, g, unknown or other
  modified_base (530)..(530): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcgctgcgtcagcacagacgtgggcccaggaccctgtgcagtgagcgaggagagtggaggaggagaggagaccaggcatgcgtggagattgtctgagtgctgtcctnttgcgccanagctgaancagacgccctaccaaacttcctanatctagtacggtaaaccngacaagtcccggccctaacgacgggggtcccctaggaccgtatttccgctcggctacccgaagttccgtcggcctacctcgaccgtcccttcccgtggttccagtccgcgttacggctccggggaggtccgttagacgtagtggacggtacttaggtaatttnttaacgttcgtacccgtaacgtaccgtttanaccggttaaacctaaaccccgtcggttgggttcccggttttgggttttccgggtcgtttcggggttccggggaccgggttaaccgggtaacccgaagggttccccgg

SEQ ID NO: 401512 - DNA, 687 bp, Homo sapiens
  misc_feature: GZ8MTXP01B64GE.21.25.C03.1.454.CMB.2.raw
  modified_base (278)..(278): a, c, t, g, unknown or other
  modified_base (288)..(288): a, c, t, g, unknown or other
  modified_base (295)..(295): a, c, t, g, unknown or other
  modified_base (301)..(301): a, c, t, g, unknown or other
  modified_base (318)..(318): a, c, t, g, unknown or other
  modified_base (338)..(338): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaggagagtgaggaggagaggagaccgaggccagtgcgtggagtattgctgagtgctgctnttgcgcccangctgaancagacnccctaccaaactcctanatctagttacggaaaacccncgactaacgtcccggaccctaacgggacccgggtccctacggtaccgtactttcccgtcgtacggaccttaccgtaacgtccgtacgaccctaccgtaccgtacccgtccccgttccgtcgtacccgtacgtccggtacggtccggtacctaccggggacggtccgtacggacgtaggtacggacgttacttagttaaactttacgttaacttccgaccttaacgttaccttaacgtaacgttaaacccgtaaacccgttccggtttaggtttccgggttttgggttttccggtccggttaacggggtttcccggggaccggggttaccgggtaacccgttcggtccgg

SEQ ID NO: 401513 - DNA, 710 bp, Homo sapiens
  misc_feature: GZ8MTXP01A1J16.21.25.C03.1.454.CMB.2.raw
  modified_base (576)..(576): a, c, t, g, unknown or other
  modified_base (612)..(612): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccgaggccagtgcgtggagattgtcctgagtgctcgtccttcgttggtcgccccagcggctaggaaacgcgaacggacgtacccctaaccctaaaaccttccctactaacgttaccgtaacgttacggggtaaaacccacggtacctaaacggttccccggaccccgttaccgggtaccgggggttcccctacgggtaccccggtattttccccgtcgttcggggacccttacccgtaacgttcgtaccgggcctacccttcgaccggtccccttcccgttggtcctacgtccgtcgtacgggccctccggggagtccgtaggaccgagtgggaacgngttagtatttagtacgttcgacctaagtacccttanacggttaaccaaccgtcccgttgggttcggttttcggggttttcggccggtttgggttcccggggcggggttacccgggaaccgttaacggttcccgg

SEQ ID NO: 401514 - DNA, 748 bp, Homo sapiens
  misc_feature: GZ8MTXP01CJLTQ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggacgccccagacaccgagggcgctgcgtcagcacagactgggcccaggaccctgtgcagtgagcgaggagagtgaggaggagaggagacaggcatgctggagtattgctgagtcgctgcctcttgtcgcccagagctagaagcagacgccctaccaaacctcctacatctagtacggtaacagacaacgtccggacccgtcgaacggggtccctagggtaacccgtctttccgtcgtacggtcccttacccgaacggttccgtacgggtaccctaaccccgtccgtaacccggttcccccgttcccgttacggggtccctacggttccggtcccggttcgggggtcccttacccggaaggggtcccgttagggaacccggtaacgtggggtaacgggttaccgttaggtttaaacgttttaactttacggttacccggtaacccgttaaacggtttcccttaaacgttaccggtaaaacccttaacccggttaaccccggtttggggtttcccgggtttttggggtttttccgggtcgggttttccggggttccgggggttacccgggggtaacccgggttaaaccgtaacccgggg

SEQ ID NO: 401515 - DNA, 602 bp, Homo sapiens
  misc_feature: GZ8MTXP01BAYV4.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcctgagtgctgcctcttgtcgcccagagctagaagcaagacgccctacccaaactcctacacttctaagtacggtaaacccaggacaacgtcccggcccctacggaccggggttccctagtacccgtatttccgtacgtcgggccttacccgaagtcgtcggccacctcgacgtccccttcccgtggtcacgtccgtcgtcgggcctccggacggtcgtagacgtatggacgtctagtatttattacgtcgcctaacgttcttatcgaacctaaccgtaccgttggttcggtttgggttttcggcgttcgggtcgggcgggaccgggtaacgaacgtccg

SEQ ID NO: 401516 - DNA, 758 bp, Homo sapiens
  misc_feature: GZ8MTXP01C9QAB.21.25.C03.1.454.CMB.2.raw
  modified_base (296)..(296): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcgagtgagcgaggagagtgaggaggagaggagaccgaggccatgcgtggagattgtcctgagtgctgtccctctttgtcgcccctaagngctagaagccagacgccctacccaaaactcctacactctagtaggtaaaccacgacaacgtcccggacccctcgaaccggggttccctaggtacccgtatttccgaccgtcgggtacctacccgtaacgttccgtacgggacctaccccgtacctacccggtccccgttccccgttcgggttaccccgtaacggttcccgtccgggttaccggggtcccttcccggggtaaacggggtccgttaacggaaccgggtagtaacgggtcgggtaccgtttacggttaattttaacgtttacgttaccgtacccggtaacggtttaccttaacgttacggaaacccgtaaaccctaccccggtttcggtttccggggtttttacgggtttttccgggtccgggtttcggggtttcccgggggaccggggttacccggggtaaccggttaacggtttaaccccggg

SEQ ID NO: 401517 - DNA, 622 bp, Homo sapiens
  misc_feature: GZ8MTXP01E3FO0.21.25.C03.1.454.CMB.2.raw
  modified_base (289)..(289): a, c, t, g, unknown or other
  modified_base (322)..(322): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgcgtggagtattgtctgagtgctgcctctgtcgaccccanagctagaagcaagacgcctaaccaaactcctanatactagtacgtaaaccagacaacgtcccggcccttaacggacggggttccctgacccgtattcgtcgtcggacctaccgaagtccgtcggccaccgtccacgtcccctccgtgcctagtccgtcgtcgggcctaccgggaggtcgtacgaacggtgtaggcggttaccgttagttatttaacttacgttccgacctaacgttacccttagaccaaaccgtaaaccctcccgttggttcggttttcgggttttcggcggtttcgggtccggggaccgggacggtaaccgaacggtcccgg

SEQ ID NO: 401518 - DNA, 798 bp, Homo sapiens
  misc_feature: GZ8MTXP01C5P4X.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgcccgtggggccccagacaccggagggcggctgcgtcagcacgagacgtcgggcccaggaccctgtgcgagtgagcggaggagagtggaggaggagaggacgaccgaggccagtgcgtggagtagttgtcgtgaggtgctcgtccttcgttgtccgccccaagacggacctagaaacgccgaacgaccgtacccccttaacctaaaacccttccctacgttaacttaccgtaagtacggtaaaaccccacggtacctaaacgtcccggtaccccgtaacgggaccggggttcccctagggtaccccgttattcccgtcgtacgggtaccctacccgtaacgttccgtacggaccctacccgtccgtacccgtccccgttcccgttcggtacctacggttccgtcggtccgggtccctaccggggtacggtcgtacggaacgtacgtacggtacggtacttaggttaacgttttaacgtttacgttaccgggtacccttaacggtttacccttaaacgtaccggttaaacccgttaaacccggtccccgttttacgggtttccgggtttttcgggtttttccgggtccgggtttccggggtttcccgggggccggggttacccggggtaaccgttaaccgggttaaccccggg

SEQ ID NO: 401519 - DNA, 775 bp, Homo sapiens
  misc_feature: GZ8MTXP01B0R35.21.25.C03.1.454.CMB.2.raw
  modified_base (455)..(455): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgcccgtggggccccagacaccggagggcggctgcgtcagcacagacgtcgggcccaggaccctgtgcagtgagcgaggagagtggaggaggagaggagaccgaggccagtgcgtggagtagttcgtccgtggaggtcgcgtcgtcccttcgtttcggccgccccaagacggcctaggaaacgccgaaggaccgtccccctaacccaaaacctttccccgtactattacgtaaagtacggtaaaccccacggactaaacgtcccggtacccctaaccgggtaaccgggggttcccctaggtaaccccgtntttcccgtcgttcgggtaccctacccgtaagttccgtcgggtacccaacccgttccgacccgtacccccgtttcccgtagggtacccacggttcccggtcggttccggggtccctacccggggaagggttcccgtacggtaaccgaagttcgggtacggtcgttaggtttaactttacgttacgttccgacccgttaacgttcccgttagtacccggaaacctaaacccgttccccgttgggtttccggtttttggggttttccggcggtttcggggtttcccggggcggggttaccgggtaaccgttaacggttcccgg

SEQ ID NO: 401520 - DNA, 633 bp, Homo sapiens
  misc_feature: GZ8MTXP01COLSI.21.25.C03.1.454.CMB.2.raw
  modified_base (260)..(260): a, c, t, g, unknown or other
  modified_base (283)..(283): a, c, t, g, unknown or other
  modified_base (292)..(292): a, c, t, g, unknown or other
  modified_base (399)..(399): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggaggtcggctgcgtcagcacagactcggcccaggaccctgtgcagtgagcgaggagagtgaggaggagaggagacagcatgctggatattgcngagtgctgcctcttgcgccccanagctagaancaagacgtccctaccaaacctccttacaattcctaagtacggtaaaccagacaacgtcccgggacccctacgggaaccggggttcccctggaaacccgtatttcccncgttacgggcctaccctaaacgttcctacggacctaacccgtccaccgtcccttccccgtcggtccacgtcgtcgtcgggcctccgggacggtcgtcgacgagtcggacgtctagtattattacgttcgccgtaacgtccttagtaccgaacctaaacccgtcccgttcggttccggtttgggttttcgcggtttcggttcgggccgggttaccgggaaccgttaacgtcccgg

SEQ ID NO: 401521 - DNA, 750 bp, Homo sapiens
  misc_feature: GZ8MTXP01CNFD8.21.25.C03.1.454.CMB.2.raw
  modified_base (287)..(287): a, c, t, g, unknown or other
  modified_base (357)..(357): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtcgggcccaggaccctgtcgcaggtgagcgaaggagagtgaggaggagaggagaccgaggcatgcgtaggagtattcgctggagtgctgtccttnttcgtcgcccagacgctagaagcagaccgcctaacccaaactcctacactacgttagtacggtaaacccngactaacgtcccggacccctaacgggtacccgggtccctacgggtaccctactttccgccgtcggtaccctaccgtaaacgttccgtaccggtaccctacccgtaccgtaccgtccccgttcccgtacggttccgtacgtccggtccggttcgggtacccgtccggggtacggtcggttacgaccggtaagtcgggtacgtacgttagttacgtttaaacgttacgttaccgtaccgttaaccgttacgttaaccgtttaaccggaaccccgttaaaacccgttcccggtttcgggtttccgggtttttcggggtttttcgggtcccgggttttcgggggtttcccggggaccgggggttacccgggtaaccggttaacgggttaaccccggg

SEQ ID NO: 401522 - DNA, 673 bp, Homo sapiens
  misc_feature: GZ8MTXP01DMLMU.21.25.C03.1.454.CMB.2.raw
  modified_base (301)..(301): a, c, t, g, unknown or other
  modified_base (318)..(318): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgcccgtggggccccagacaccggagggcggctgcgtcagcacagacgtcgggcccaggaccctgtgcagtgagcgaggagagtggaggaggagaggacgaccgaggccagtgcgtggagtattgtccgtgagtgctcgccttcgttgtcgcccanagctagaacgcaagacncctacccaaaactcctatactactagtacggtaaaccagactaacgtcccggccctacggacgggtccctacgacccgtattcctcgtcgggtacctaccgtaagtcgtcggaccaccgtcaccgtccccgtacccgttgggtacctacgtccgtcggttcggggtcccgttacccggggaggtccgtaggtaaccggtaagtcgggacggtacttaaggttatttatttacgttacgccgtaacgttaccttagtacgaaaccgtaaaccgtcccgttgggttcggtttcgggttttcggccgtttcggggttccggggccggggttaccgggtaaccgttaacggttcccggg

SEQ ID NO: 401523 - DNA, 821 bp, Homo sapiens
  misc_feature: GZ8MTXP01EUYJJ.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgctggagattgtctgagtgctgcctctgtcgcccanacgctaggaagcaagcgaccctacccaaactcctatacgtctaagtaggtaaacccagtactaacgtcccgggtaccccttaccgggaacgggggttcccctagggtaccccgttaagtttcccgtccggttacggggcccttaacccgtaaacggtttcccgtaccggggacccctaaacccttcccgtaacccggtacccccgtttccccggttacgggttacccgtaaccggttcccggtaccggttacgggggtcccctttacccggggaaacggggttcccggttacggtaaccggtaaacgttggggtaccgggggttacttaacggtttaaagtttttaaccttttaagttaccggtacccgttaacggttaccctttaaacgttaccgttaaacccgttaaacccgtaacccccgttggggttttacccgggttttgggggtttttttccgggtccggttttcggggtttccccgggggtaccgggggttacccgggtaaaccccgggttaaacggttaaccccgggg

SEQ ID NO: 401524 - DNA, 620 bp, Homo sapiens
  misc_feature: GZ8MTXP01BEJ2Z.21.25.C03.1.454.CMB.2.raw
  modified_base (273)..(273): a, c, t, g, unknown or other
  modified_base (297)..(297): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagacgtcgggcccaggaccctgtgcagtgagcgaggagagtggaggaggagaggacgaccgaggccagtgcgtggagtattgtccngagtgctgcctgttcgcgccccangctaggaagcgaagacgcctaacccaaacttcctacattctagtacggtaaaccaggactaacgtcccggaccctaacgggaccggggttccctcggaacccgtatttccgtcgtacgggtcctaccgaacgttcgtcggcctacccgtcgaccgtcccctccgtcggtcacgttccgcgtcggccctcgggaggtcagacgagtggacgtcgttagtattattacgtcgcctaagtccttagtacgaactaaaccgtccgttggttcggtttggtttcggcgtttcgggtccgggcgggttaccggaaccgttaacgtccgg

SEQ ID NO: 401525 - DNA, 668 bp, Homo sapiens
  misc_feature: GZ8MTXP01ADGGW.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgcgcccanagctgaagcagacgcctaccaaactcctacatctaagtacggtaaaccacgactaaacgtcccggtccctaaccgggaaccgggggttcccctagggtaaaccccggttatttaccgtcccggtttagggccccttaaacccgtaaacggttccttacggggaaccctacccgttaccgaaccgtccccgttccccgttgggtaccctacgttccggtcgttccgggaccttccgggaacggtcgtacggaccgtaagtcggaaggtccttaggtaatttagttatttcgccgtaataccgttatcgaactaaacccgtccgttggttcggtttcgggtttggtcgtcggttacgggcgggttaccggaaccgaagtcccgg

SEQ ID NO: 401526 - DNA, 688 bp, Homo sapiens
  misc_feature: GZ8MTXP01BYQEM.21.25.C03.1.454.CMB.2.raw
  modified_base (261)..(261): a, c, t, g, unknown or other
  modified_base (286)..(286): a, c, t, g, unknown or other
  modified_base (320)..(320): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctggagattgtcngagtgctgcctgttcgtcgccccangctaggaacgcaagacgccctaccaaactcctanatctaagtgtaaaccagacaagtcccggccctacgacggggttcccagtacccgtattccgtcgtcggacctacccgtaacgtcgtcggccacctcgacgtcccctcccgtcgtcctacgtccgtcgtcgggtcctccgggtaacgggtccgttacggaaccggtacgttacgggacggtacctttaggtaaacgttttaacgtttacgttacgtacccgtaacggttaccccttaaagtaccggttaaaccctaaacccgtaaccccgtttcgggtttccgggtttttcggggttttttcgggtccggtttcggggtttcccgggggaccggggttacccgggggaaccgttaaaccgggttcccgg

SEQ ID NO: 401527 - DNA, 729 bp, Homo sapiens
  misc_feature: GZ8MTXP01B4GTT.21.25.C03.1.454.CMB.2.raw
  modified_base (267)..(267): a, c, t, g, unknown or other
  modified_base (280)..(280): a, c, t, g, unknown or other
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccatgcgtggagtattgtccnggagtgctgcctnttgcgcccangctagaagcaaggacgcccctacccaaaccttcctactactacctagtacggtaaaccacgtacaacgtcccggccctaacgggaccggggttcccctagaacccgtatttccgtcgtcgggtacctacccgtaacgttccgtacggccctacccttaccgaccgtcccccgttcccggttcggtacccgtaacgttcccggccggttcggggtcccttacccgggggacgggtccgttacggaccggtaagtcgggacggttcgttaaggttatttaagtttacgttccggacccgttaacggttaacccttaagtacggttaaaccctaaacccgttccccgtttgggtttccgggttttcggggtttttcgggtccggtttccgggggtttcccgggaccggggttacccggggtaacccgttaacgggtccccgg

SEQ ID NO: 401528 - DNA, 780 bp, Homo sapiens
  misc_feature: GZ8MTXP01EIA63.21.25.C03.1.454.CMB.2.raw
  modified_base (293)..(293): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacgagacctcggggcccaggaccctgtgcagtgagcgaggagagtgaggaggagaggagaccaggccatgcgtggagtattgtctgagtgctgcctcgttagcgccccanagctaggaaacgcaagacgtccctaaccctaaaacttccctcaaattccgtaaagtacggtaaacccaggtacctaaagtccccgggacccctaaccgggaacgggggttccccctagggtaacccgttatttcccgttcgtccggggaccctttacccgtaaacgttccgtacgggtccctaaccctccgtaacccggtccccgttcccggttccgggttccacgttccggtccggttcgggcccgttccggtaacgggtcgttacggaccggtagtagggaacggttcgttaaggttaagtttaactttaacgtttcgtacccgtaacggtttcccttaaacggtaaccgttaaaccggtaaaccccttaccccggtttcgggtttcccgggtttttaggggttttttccgggtcgggtttccggggtttcccgggggaccgggggttaaccccggggttaacccggttaaacgggttccccggg

SEQ ID NO: 401529 - DNA, 615 bp, Homo sapiens
  misc_feature: GZ8MTXP01BA6FE.21.25.C03.1.454.CMB.2.raw
  modified_base (263)..(263): a, c, t, g, unknown or other
  modified_base (305)..(305): a, c, t, g, unknown or other
  modified_base (479)..(479): a, c, t, g, unknown or other
  modified_base (501)..(501): a, c, t, g, unknown or other
  modified_base (604)..(604): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgcccgtggggccccagacaccggagggcggctgcgtcagcacgagacgtcgggcccaggaccctgtgcagtggagcggagagagtggaggagagaggagaccgagcatgcgtggatnttgctgagtgctgtcctgtgcgacccagagctagagcaagcnccctaccaaacttccataatactagtaacggtaaacaggactaacgtcccggccctaacggacgggtcccctaggaaccgtagtttcctacgtcggtacctacgtaactcgtacggcctaacccgtcgtaccgtccccgtcgtgttaccgacgtccgcgtacggcctaccgggngtcgtagacgtggtacgtagtnttaagtatttagtacgttcgactaacgtcttagtacactaaaccgtcttacggttcggttttcgggttaacgtcggttcggttcggggcggttaccggtaacngggttaacccg

SEQ ID NO: 401530 - DNA, 726 bp, Homo sapiens
  misc_feature: GZ8MTXP01AJ4MD.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactcgggcccaggaccctgtgcagtgagcgaggagagtgaggaggagaggagacgaggccatgctggagtattgtcctggagtgctcgtccttcttgtcgccccaacgagtcctaggaacgcgaaggaccgtacccctaccctaaaacttcctactaacttctaaagttacgggtaaacccacggactaaacgtcccggccccgttaacgggaccggggttcccctaggtaaccccggttatttccccgtcgtacggggtcccttaacccgtaacgttcccgtcggaccctacccgtaccgtacccgtccccgttcccgtcggtccgaccgtccggtcgtccgggtcccgtcccgggtacggccgttcggaaccgtagtcggacgtacgttagtaacttttagttacgttccgaccgttaagtacccttagtacggttaaccctaaaccgtacccgttcggtttcggtttcgggtttttcggtccggtttcgggttccggggaccgggttaccgggtaacccgttaacggttccccgg

SEQ ID NO: 401531 - DNA, 674 bp, Homo sapiens
  misc_feature: GZ8MTXP01BK7Z9.21.25.C03.1.454.CMB.2.raw
  modified_base (283)..(283): a, c, t, g, unknown or other
  modified_base (293)..(293): a, c, t, g, unknown or other
  modified_base (322)..(322): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggcccccagacaccggagggcggctgcgtcagcacagactgggcccaggaccctgtgcagtgagcgaggagagtggaggaggagaggacgaccgaggccagtgcgtggagattgtcctgagtgctgcctntgtcgcccangctgaagcagacgcctaccaaacttcctntatctatacggtaaccagactaacgtcccggccctacggaccggggtcccctaggtacccgtatttccgtcgttcgggaccttaccctaaacgtccgttaccgggacccaacccgttcccggacgttcccccgttcccgttcgggtcccaacgttccggtcgtcgggggtccccttccggggaacggtcgtacggaccgtaagttcggagttccgtagttatttattacgttcgccttaacggtccttacgtacgttacctaaaccgtccccgttggttccggttttcgggttttggtccggttcgggttccggggaccggggttacccggggtaacttaacgggttcccgg

SEQ ID NO: 401532 - DNA, 674 bp, Homo sapiens
  misc_feature: GZ8MTXP01BQV6H.21.25.C03.1.454.CMB.2.raw
  modified_base (282)..(282): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtggagtatgtctgagtgctgcctgttgcncccangctagaacgcaagacgaccctacccaaactcctacaattcctaagtacggtaaaccaggactaacgtcccggaccctaacggaccggggttcccagaacccgttacttccgtacgtcgggtacccttaccgtaacgttcgtcggtacctacccgtaccgaccgtccccttcccgtggtacctacgttccgtcgttcggggcccttaccgggaacggtcgtacgacgtacgtaggacggtcgttagttaactttagttacgttccgaccgtaacggttcccttaagtaccgaaacctaaaccgtaccccgttgggttccggtttcgggttttcggcggttaacgggttccggggaccgggttaccggggtaaccgttaacggtcccgg

SEQ ID NO: 401533 - DNA, 727 bp, Homo sapiens
  misc_feature: GZ8MTXP01ATLNE.21.25.C03.1.454.CMB.2.raw
  modified_base (265)..(265): a, c, t, g, unknown or other
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgctggagatgtccngagtgctgcctcttgtcgccccanagctagaacgcaagacgcctaccaaactcctacatctatcggtaaaccagacaacgtccggaccctacggtacggggtccctaggacccgtatttcccgtacgtcgggccttacccgaaacgttccgttcgggaccctacccttccgaaccggtccccgttccccgtgggttaccctaacgttcccggtcgttccgggggtcccttccggggaacgggtcccgttaggaacccgtagttcggacgggtcctttaaggtaattttaacgtttaacgttcgtcccgttaacggttacccttacgttaccggttaaaccctaaacccgttaccccgttacgggttccggtttttacggggttttttccgggtacccggtttcggggtttcccgggggacccggggttacccggggtaaaccccgttaaggggttcccccgg

SEQ ID NO: 401534 - DNA, 620 bp, Homo sapiens
  misc_feature: GZ8MTXP01DJ277.21.25.C03.1.454.CMB.2.raw
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggacgaccaggccagtgctggagtattgtctgagtgctgcctcttgtcgcccangctagaagcagacgccctaccaaactcctacattctatcggtaaaccagtacaagtccggcccctacgacggggttcccctagaacccgtatttcccgtacgtcgggtaccttacccgtaacgttccgtacgggaccacccgttaccacgtaccccttcccgtacgggtccacgtcccgtcgtacggaccctccgggtaacggtcgttacggaccgtagtcggagggtcctagttaacttattactcgctaacgtccttatcgactaaacctcccgttagttcggttggttttcgggcgttggtcgggcgggttaccggtcgaacggtccg

SEQ ID NO: 401535 - DNA, 707 bp, Homo sapiens
  misc_feature: GZ8MTXP01A36TN.21.25.C03.1.454.CMB.2.raw
  modified_base (629)..(629): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggcccccagacaccggagggcggctgcgtcagcacagactgggcccaggaccctgtgcagtgagcgaggagagtgaggaggagaggagacaggccagtgcgtggagtattcgtcctggagtgcgtcgccttcttggtacgccccaagtagcctaggaaacgccgaaaggtaccgtaccccctaaccctaaaacccttcccctactaacttaccgtaaagttacgggttaaaacccacgacctaaacggtccccggggtaccccctaacgggtacgggggtcccccctaggtaaccccggttatttcccgtcgtcgggtacccttaacccgaacgttccgtacgggccctaaccttcgacccgtcccccgttccgtcgggttacacgttccggacgttcggggccttcccgggaaggtccgtacgaccgtaagtcgacggtcttagtaatttagttacttcgccctaagttaccttanaccgaactaaccgtacccttggttcgtttcggttttcgggctttcggtccgggcggaccgggtaaccgaacggtcccg

SEQ ID NO: 401536 - DNA, 399 bp, Homo sapiens
  misc_feature: GZ8MTXP01BJ5AI.21.25.C03.1.454.CMB.2.raw
  modified_base (236)..(236): a, c, t, g, unknown or other
  modified_base (269)..(269): a, c, t, g, unknown or other
  modified_base (349)..(349): a, c, t, g, unknown or other
  modified_base (355)..(355): a, c, t, g, unknown or other
  modified_base (358)..(358): a, c, t, g, unknown or other
  modified_base (386)..(386): a, c, t, g, unknown or other
  modified_base (388)..(388): a, c, t, g, unknown or other
  modified_base (391)..(399): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacacgcccccaaactcctcatctatggtaacagcaatcggccctcgaggggtccctgaccgattctctggctccaagtctggcacctcagcctcctggtcatcgcttggctccaggctgacgntgagctgattattatgccagtcctatgaacacncctgtcgtggttttgctgtcggcggcggacagctgaccgtctagtcacgccgagctcgccccgtgtccactctcgtcccncctccncgngcacgactgacgcgggctggacaggccnanagnnnnnnnnn

SEQ ID NO: 401537 - DNA, 699 bp, Homo sapiens
  misc_feature: GZ8MTXP01A9QWD.21.25.C03.1.454.CMB.2.raw
  modified_base (211)..(211): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctcgcccgtgggccccagaccaccggagggcggctgcgtcagcacagacgtcggcccaggaccctgngcagtgagcgaggagagtggagggaggagaggacgaccgaggccagtgcgtggagtattcgtccgtggagtcgctcggtcctcgttggtccgcccagacgctaggaacgcacgaccgaccctaacccaaaccttcctactatactagtacgtaacccacgactaacggtcccggcccgtacgggtaccggggtccctacggtacccgtacttccgtcgtcgggtcctaccgtaacgttcgtacggccctaccgtcctaccgtcccgtccgtgtccgacgttccgcgtcgggtcctcgggacggtcgtacggaccggtagtcggtacgtcgttagttaacgtttaacgttacgttaccgcccgttaacggtaccttacgtacgaacccgtaaaccgtcccggtttcggttcgggttttcgggttttcgggtcggtttccggggtaccggggccggggttacccggtaaccgttaacggttaaccccggg

SEQ ID NO: 401538 - DNA, 707 bp, Homo sapiens
  misc_feature: GZ8MTXP01C7CQQ.21.25.C03.1.454.CMB.2.raw
  modified_base (318)..(318): a, c, t, g, unknown or other
  modified_base (356)..(356): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcggcccgtcggggccccagacaccggagggcggctgcgtcagcacgagacgtcgggcccaggaccctgtgcagtgagcggaggagaggtggagggaggagagggacgaccgaggccagtgcgtgggacgtagttcggtcctggaggtgctgtcccttcgttaggtcgccccanaggctaggaacgcagaccgccctaacccaaactcctanacttactagtacggtaaaccacgactaacgtcccggcccctaacgggtaccgggggttcccctaggtaaccccgttatttccgtccgtcgggtacccttacccgtaacgttccgtccgggaccctacccgtccgacccggtccccttccccgtggtacccgtcgtccgcggtcgggcccttccgggagggtccgtaggaccgtagtcggaacggtcgttaagttaatttacgttacgttccgtccgtaacgttccttaagttaccgaaacctaaacccgtcccgttgggttcggttttcgggttttcggcgttcgggttcgggccgggttacggaaccgttaacggtccgg

SEQ ID NO: 401539 - DNA, 604 bp, Homo sapiens
  misc_feature: GZ8MTXP01C7E8B.21.25.C03.1.454.CMB.2.raw
  modified_base (261)..(261): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgagagagtgaggagagaggagaccaggccatgctggagattgtccngagtgctgcctcttgtcgcccaacagctagaagcaagacgcctacccaaactcctacactactatacggtaaaccaggacaagtcccggccctaacgggacggggttcccctaggacccgtatttcctaccgttgggcctaccgaagttcgtcggccacctcgacgtcctcccgtggtccatcgcgtcggggacctccggacggtcgtaggaaccgagtggaacggtcttagtaattattaagtcgtaccgtaagtacccttagtacgactaaacgtccttggttccgtttaggttttcggtacgtcgggttacggcgggttacggtaaccgttaacggtccg

SEQ ID NO: 401540 - DNA, 725 bp, Homo sapiens
  misc_feature: GZ8MTXP01ANA66.21.25.C03.1.454.CMB.2.raw
  modified_base (251)..(251): a, c, t, g, unknown or other
  modified_base (264)..(264): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgntggagattgtccngagtgctgcctcttgcgccccanagctagaagcagacgcctaccaaactcctacaatctagtacggtaaaccaggactaaacgtcccgaacccttaccggaacgggggttcccctacgggtacccgtatttccgtacgtgggacctaccctaagtccgtacgggtcctaacccgtcctacccgtccccgttcccgttcgggtcctaaccgttccggaccgttcgggggtccctaccggggtacgggtaccgttacgggaaccggtagttaccggagggtacctttacggttaattttaacgttttaacgttcgtcccgtaacggttacccttaaaggttaccgaaacccgtaaaccctaaccccggttcggttcggttttccggggtttttcgggtcccggtttcggggttccccggggtaccgggggttacccggggaacccgttaacgggttccccggg

SEQ ID NO: 401541 - DNA, 623 bp, Homo sapiens
  misc_feature: GZ8MTXP01C0B6S.21.25.C03.1.454.CMB.2.raw
  modified_base (331)..(331): a, c, t, g, unknown or other
  modified_base (384)..(384): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagacgtgggcccaggaccctgtgcagtgagcgaggagagtgaggaggagaggagaccaggccatgctggagtattgtcctgagtgcgtgccttcgttgtcgcccctagagctaggaacgcaagacgtcccctaccaaactcctanaactctagtacggtaaaccacgactaagtcccggccctaacggacgggtcccngaaccgtattccgtcgtcgggtcctaccgaagtctcggacctacctcgaccgtcccttcccgtgtcacgttcgcgtcgggcctcggaggtctcggacgtagtggacggtcttagtaatttacgttacgtcgccttaaggtccttaacgtcgaacctaaaccgtcccgttggttccggttttgggtttttcggccgtttgggttccggggcgggttaccgggtaaccgttaacggtcccg

SEQ ID NO: 401542 - DNA, 692 bp, Homo sapiens
  misc_feature: GZ8MTXP01B1S51.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtcggggccccagacaccggagggcggctgcgtcagcacagacgtcgggcccaggacctgtgcgagtgaggcgaggagagtggaaggaggagaggacgaccgaggcagtcgacgtggaagtgttgtaccgtggagtgctcgtccttgttcgccgaccccagacggtctaggaacgcgaacgaccgtaccccttaacccaaaacttcctataacttacgtaaacgttacggtaaacccacgtacctaacggttccccggaccccgttagggtaacccgggggttccctacgtaaacccgttagtttcccgtacgttaccggggtaccttaacccgtaacggttccgtaccggacctacccgtaccgccgtccccttaccgtagtccgacgttcgaccgggttcggacccctcggggaagtcggtacgagacgtggcggtacttaggtatttatacgtcacgtaacttacacgtacgactaacccgtcgttgtttcggtttggtttcgtcgttaaggttcccgggcggttacgtcgaaccggtcg

SEQ ID NO: 401543 - DNA, 645 bp, Homo sapiens
  misc_feature: GZ8MTXP01AVIZC.21.25.C03.1.454.CMB.2.raw
  modified_base (390)..(390): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccatgctggagattgtctgagttgctgtcctcttgcgacccagagctagaagcaagacgtccctacaaaccttccacgtatctaagtacggtaaaccagactaacgtccggaccctaagggaccgggtccctaggaacccgttnttccgtgtcgacctacgtacgtcgtacgacctaccgtcgaccgtcccgttccgtcggtcctacgtccgtccggtcggtccgtaccggggtacggtcgtacggacgtacgtacgggagtacttagttaacttacgttagtcccgtactaacgttaccttaacgtaccgaaaccgtaaaccgtccggttgggttccggtttgggtttcgtcggttcggggttaccggggacggttacgggtaaccgttaaggtcccg

SEQ ID NO: 401544 - DNA, 761 bp, Homo sapiens
  misc_feature: GZ8MTXP01CCOH6.21.25.C03.1.454.CMB.2.raw
  modified_base (255)..(255): a, c, t, g, unknown or other
  modified_base (330)..(330): a, c, t, g, unknown or other
  modified_base (615)..(615): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaaggagagtggaggaggagagggagaccgaggccagngcgtgggagtagttcgtcctggaggtgccttcggtcccttcgttgtccgcccccaaagacgtaccgtaggaaacnccgaaaggaccgtacccccttaacccgtaaaaccttccctacaactttacgtaacgttaacggggtaaaacccccaggtaaccgtaaacgttccccggggacccccttaagggtaacccggggttcccctggtaaacccgtcttcgtccgtcggtacctaaccgtacgtccgtcggaccctaccgtaccgcgtccccttcccgtggtacctacggttccgcgttcggggtccctacgggacggtcgtacggaccgtaagtgggaacgttcgttagttaacgtttnttaccgttcgcccgttaaacgtcctttaacggaccgttaaaccgtaaacccgttccgttcgggttcgggtttttcgggttttaaggggcccgtttaacggggttcccgggacgggggttaacccggtaaccgttaaccggtcccgg

SEQ ID NO: 401545 - DNA, 719 bp, Homo sapiens
  misc_feature: GZ8MTXP01BCIMG.21.25.C03.1.454.CMB.2.raw
  modified_base (268)..(268): a, c, t, g, unknown or other
  modified_base (293)..(293): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagacgtcgggcccaggaccctgtgcagtgagcgaggagagtggaggaggagaggagacaggcatgcgtggagtattgtcngagtgctgtcctctcgtcacccagngctagaacgcaacggacctccctaacccaaacttcctactaacttactaagtacggtaaacccaggtactaacggtccccggccccgttaagggacccggggttcccctgggaaaccccgtttctttcccgttacggtccgggtacccttaacccgtacggttcgtacccggaccctacccgtaccgaccgttcccccgttacccggttggtaccctcgtcccggtcggtcgggtccctacccggggaggtcgtacggaacgtgtacggacggtcttaaggttatttaacgtttcttccgaaccgttaacggttccttaacggttaaccgaaacccgttaacccggtccggtttcggtttcgggttttacggttttcgggcggtttcgggttccgggggcggaccggtaaccgttaacggtcccgg

SEQ ID NO: 401546 - DNA, 724 bp, Homo sapiens
  misc_feature: GZ8MTXP01DKGMT.21.25.C03.1.454.CMB.2.raw
  modified_base (264)..(264): a, c, t, g, unknown or other
  modified_base (276)..(276): a, c, t, g, unknown or other
  modified_base (286)..(286): a, c, t, g, unknown or other
  modified_base (341)..(341): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtgggcccaggaccctgtgcagtgagcgaggagagtgaggaggagaggagaccaggcatgctggagtattgtcngagtgctgcctnttgcgcccanagctagaacgcaagacgaccctaccaaactcctacattactagtacggtaaaccncgtacaacgtccggacccctaacggaaccggggttccctagacccgtatttccctacgtcggacctacccgtaaacgtccgtacggacctaaccccgtcgaccgtcccctttcccgtacgggtccaaccgttcccggtcggtcggggtacccttacccggggaacggtccgttaggaaccgtagttacggacgggtcttaaggttaatttaacgttacgttccggaccccttaaaggttcccttaacgttaaccggaaaccctaaaaccccgttcccgttcggggtttacccgggtttttggggtttttccgggccggttttccgggggtttacccgggggacccggggttacccgggggaaacccttaacgggttccccggg

SEQ ID NO: 401547 - DNA, 553 bp, Homo sapiens
  misc_feature: GZ8MTXP01CG231.21.25.C03.1.454.CMB.2.raw
  modified_base (332)..(332): a, c, t, g, unknown or other
  modified_base (357)..(357): a, c, t, g, unknown or other
  modified_base (368)..(368): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaaagcaagagcctccaaaactcctcatctatggtaaacccngcaatcggccctcaaggggtccccngaccgatttcnctggctcaagtctggcacctcacgcctccctcgtcatcgcgtcggcgtccgcggcgtcgacggaacgtgacgcgtagtattattattcgtcgtaacgtacttatacgaacgtaaacctaccgttcgttcggttcggtttcggttcggttcggttcgggtcgggccgggtaaccggaacggtaacg

SEQ ID NO: 401548 - DNA, 627 bp, Homo sapiens
  misc_feature: GZ8MTXP01APCMM.21.25.C03.1.454.CMB.2.raw
  modified_base (283)..(283): a, c, t, g, unknown or other
  modified_base (293)..(293): a, c, t, g, unknown or other
  modified_base (302)..(302): a, c, t, g, unknown or other
  modified_base (324)..(324): a, c, t, g, unknown or other
  modified_base (343)..(343): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccctggggcccccagacaccggagggcggctgcgtcagcacagactgggcccaggaccctgtgcagtgagcgaggagagtgaggaggagaggagaccaggccatgcgtggagtagttgtccgtggagtgctgcctntgtcacccanagctagaancagacgccctaccaaactcctnatctagtcggtaaaccccnggactaacgtcccggccccttaacggacggggttccccacgacccgttattccgtacgtcgggacttacccgtaagttcccgtacgggccctaacccggtcaccgtccccgttccccgttggttaccacgttccggcgtcgggtcccacggggaggtccgtagaccgtagtggacgtcggtaattacttaggttatcgaccgtaagtccttagtcgaccgtaactccgttggttcggtttggtttcggcttaacgggtcggcggaccgggaacttaacgtccgg

SEQ ID NO: 401549 - DNA, 597 bp, Homo sapiens
  misc_feature: GZ8MTXP01AKB93.21.25.C03.1.454.CMB.2.raw
  modified_base (285)..(285): a, c, t, g, unknown or other
  modified_base (298)..(298): a, c, t, g, unknown or other
  modified_base (311)..(311): a, c, t, g, unknown or other
  modified_base (327)..(327): a, c, t, g, unknown or other
  modified_base (358)..(358): a, c, t, g, unknown or other
  modified_base (361)..(361): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctggagattgtacctgagtgctgcctctgtcgcccangctgaagcagacncctacaaactccnatctatcggtaaaccngacacgtccgcctaacgacggtccacgactntcncgtcgctacagtctcgcactcgacgtcctccgtgtacacgtcgtcgtacggtcctaccgggacggtcgtagacgtagtcgacgtacttacgttattaacgttacgtccgaaccgtaacgttaccttagtaaccgaaacccgtaaacccgtccggttgggttcgggttttcgggtttcggtccgggtttcggggttacccggggacgggttaccgggtaaaccgttaacggtcccgg

SEQ ID NO: 401550 - DNA, 671 bp, Homo sapiens
  misc_feature: GZ8MTXP01ASC7L.21.25.C03.1.454.CMB.2.raw
  modified_base (268)..(268): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaggagagtgaggaggagaggagaccaggccatgcgtggagtagttgtccnggagtgctcgtcccttcgttgtcgccccaagagctaggaacgcaaggaccgtcccctaacccaaaaccttccctactaacttacctaagtacggtaaacccacggacctaacgtcccggcccctacgggaccgggggttccctacggacccgttatttccgtcgtcggccttaccgaagttccgtacggccctaccttccgaccgtccccgtccgtggtccacgtccggcgtcgggtcctaccgggaggtcctaggacgtagtggtacgtcttagtattattacgtcgacctcgttcttagtacaacctaaccgtccggttggttcgggttttcgggtttttaacgggccgtttcggggttccggggaccgggggttaccggtaaccgttaacgggttcccgg

SEQ ID NO: 401551 - DNA, 674 bp, Homo sapiens
  misc_feature: GZ8MTXP01AQXG3.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagacgtcgggcccaggaccctgtcgcaggtgaggcgaggagaggtagagggaggagaggacgaccgaggccaagtgcgtggagtatcgtctggacgtcgcgtcgtccttcgtcggtccgacccctacgacgcgtaggaacgcgaacggaccgtacccctaccctaaacctcctataacttcgttaagtacggtaaaccacgactaacgtcccggcccgtacggaccggggttccctaggcccgtacttcctacgtcggaccttacgaacgtcgcggtacctcctccgacgtccccgtccgtacggtcacgttccgacgtcgggtccaccggtacgggctacggtaacgtgtcggaagtcgttaagttaatttacttacgtcggaccttaaggttacccttagtacccgaactaaccgttcccggttggtttcggtttcgggtttgcgtttaacgggtccggggcgttaccgggaacgttaacgtccg

SEQ ID NO: 401552 - DNA, 615 bp, Homo sapiens
  misc_feature: GZ8MTXP01EY5QM.21.25.C03.1.454.CMB.2.raw
  modified_base (276)..(276): a, c, t, g, unknown or other
  modified_base (286)..(286): a, c, t, g, unknown or other
  modified_base (314)..(314): a, c, t, g, unknown or other
  modified_base (479)..(479): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtcgaccgtctgccctggggccccagacaccgagggcggctgcgtcagcacagactgggcccaggaccctgtgcagtgagcgaggagagtgaggaggagaggagacaggccatgcgtggagattgtcctgagtgctgcctnttgcgcccangctgaagcagcgcctaccaaactcctanatctagtacggtaaaccagactaacgtcccggacccctacggacgggggtcccctagggacccgtactttccgtacgtggcctaccgtaacgtcgtcggacctacctcgacgtccctcccgtcggtccacgtcgcgttcgggcctccgggaaggtcgtacgacgngtgacggtcttagtatttatttacgtcggtcctaacggttccttagtacgttaacctaaaccgtcccgttggttcggttttgggttttcggcgttcgggttaccgggcgggttaccgggaaccgttaacgtcccgg

SEQ ID NO: 401553 - DNA, 662 bp, Homo sapiens
  misc_feature: GZ8MTXP01A0EL6.21.25.C03.1.454.CMB.2.raw
  modified_base (228)..(228): a, c, t, g, unknown or other
  modified_base (274)..(274): a, c, t, g, unknown or other
  modified_base (284)..(284): a, c, t, g, unknown or other
  modified_base (309)..(309): a, c, t, g, unknown or other
  modified_base (515)..(515): a, c, t, g, unknown or other
tcagtcgtcgctcgcacgaccggtgctcgatttagtagtgtagatttgggtttgggggctgttcctggaagttgctgataccagggcacatcaaaaaggtgacccgatgttggagctgctcccagcgcaggagatggtgaccgtctcgcccgtcggggccccagaccgaccggagggcggctgcgtcagcacgagacgtcgggcccagggaccctggtgcaggtgagnggaggagaggtggaggaggagaggacgacgagcagtgcgtggagtnttcgtcgtgngtcgctcgtccttgttcgcgccacngcgtagacgcgacgaccgtcctaacctaaacctcctactactacgttaagtacggtaaaccgaccgacgtaacgtcccggtaccccgtaccggtaacccggggttccctaacggtacccgttacgttcccgtcgtccgtacctaccgtaacgttcgtcggaccctctaccgccgtccctaccgtgtacctgtccgcgtcgggaccncggacggtcgtaggacgtgtacgcggtattgttaattagttcgtaccgtctacgtaactaagccgtaaacttccgttccggttggttccggttttgggtttcgcggttcgggaacggcggggtaccgaactcggttcgtaacccggg

SEQ ID NO: 401554 - DNA, 595 bp, Homo sapiens
  misc_feature: GZ8MTXP01AK8MS.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggttaccgtctgccctggggccccagacaccgagggcggctgcgtcagcacagactgggcccaggaccctgtgcagtgagcgaggagagtgaggaggagaggagaccaggccatgctggagtattgtcctgagtgctgcctcttgcgcccanagctagaagcagacgcctaccaaactcctacactctaatcggtaaacacgacaacgtcccggacccctcggaacggggttccccttgacccgtactttcctcgtcgggtctacccgtaagtcctggccctaccctcgcgtccctcccgtaggtctacgtccgtcgtcgggcctaccgagggggtctggacgagtggacgtctagtactttaagtgttcgcctgtcctattacgaaccaaccgtcccgtggttccgtttggtttcggtcgttcggttccgggcgggtccgacgtaacgcgttaacccggg

SEQ ID NO: 401555 - DNA, 552 bp, Homo sapiens
  misc_feature: GZ8MTXP01DAHPA.21.25.C03.1.454.CMB.2.raw
  modified_base (287)..(287): a, c, t, g, unknown or other
  modified_base (337)..(337): a, c, t, g, unknown or other
  modified_base (384)..(384): a, c, t, g, unknown or other
  modified_base (456)..(456): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggccccaggaccctgtgcagtgagcgaggagagtgaaggaggagaggagaccaggccatgctggagattgtctgagtgctgcctctgtcgcccanagctagaagcagacgccctaccaaaactcctacatctatacggtaaaccnggacaagtccggccctagaaccggggtccctaggacccgtatttccncgtcggcctaccgaacgtctcggaccacctcacgcctccctggtcagtcgctgggcctccgaggctagacgntgaggcttagtattattactgcctaagtccttagtacacgaacctaccgttgttcgttagggttttgcgttggtcggcggacggaacgaacgtccg

SEQ ID NO: 401556 - DNA, 771 bp, Homo sapiens
  misc_feature: GZ8MTXP01BP3Q3.21.25.C03.1.454.CMB.2.raw
tcagtcgtcgctcgcacgaccggtgctcgatttagtagtgtagatttgggtttggggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaggagagtgaggaggagaggagaccgaggccagtgcgtggagtattgtccgtggagtgcgttgcccttcgtttgtcgccccaaacgagacctaggaaagccgaagaccgtcccctaacccaaaaactcccttacaatttacctaaagtacggtaaaacccaggtaccaaaacgttcccgggacccccttaacgggaccgggggtttcccccaggtaaacccggtaactttcccttaccggttcgggaccctttaacccgaaacgttccgtacgggaccctacccgtccaacgtccccttccccggttaggtaccacgtccggtctccgggggtacctccgggaaacgggtcccttaaacggaacggtaacgtacggacggtacttaggttaaatttaatttaacggttccaccgtaacggttcccttaaagttaccggaaaccctaaacccgtaaccccgttgggttcgggtttttacgggtttttcgggtccggtttcgggttacccgggggtcccgggggaccgggggtaaacccgaaacggttccccgg

SEQ ID NO: 401557 - DNA, 750 bp, Homo sapiens
  misc_feature: GZ8MTXP01AIYJV.21.25.C03.1.454.CMB.2.raw
  modified_base (206)..(206): a, c, t, g, unknown or other
  modified_base (439)..(439): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgngcagtgagcgaggagagtgaggaggagaggacgacgaggccagtcgctgggagtagttgtccgtgagtgctcgccttcgttcgtcgccccaacaggtcctaggaaacgcgaacgaacgccccttaacccaaaaccttcctacctaacttaccgtaacgtacggtaaacccgacgacgtaaaccgtcccggccccttaacgggtaacccgggggttcccctacggtaacccgtntttaccgtccgtcgggacctacccgtaacgttccgtacgggccctaccctcgtaccgtccctcccgtaggtcctaccgtccgtcgtcgggtcctccgggtacggtcgtcgaaccggtagtacgggacgttaccgttgttaaactttaagtttacgttacggtacccgttaacgttaccccgtttaagaccgttaaaccgtaaacccgttcccggttcgggtttcccgggttttggggtttttcgggtccgtttccgggggtttccgggggacccggggttaccggggtaacccggttaaacggtccccggg

SEQ ID NO: 401558 - DNA, 694 bp, Homo sapiens
  misc_feature: GZ8MTXP01AWGSS.21.25.C03.1.454.CMB.2.raw
  modified_base (270)..(270): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggacgaccgaggccagtgcgtggagtagttgtccnggagtgctcgtcccttgttacgtcgaccccaagagtccgtaggaaacgtcgaaacggacgtaccccttaacccaaaaccttccctactaacttaccttaaagtcgggttaaaacccacgggtactaaacggtccccggtacccttaaccgggtaccgggggttcccctaggtaaccccggtatttcccgtccgtacgggtacctaccgaaacgttccgcggacctaccctccacgtccctccgttggcacgttcgcgttcgggccttcgggacgcgtacgacgtagtcggacgtcgttagtacttagtttacgtcgtccctaacggttcccttaagtccgaacctaacccgtaccttcgggttcgttttcgggttttcggcgtttccgggtcgggaccgggttaccggtaaccgaacgtcccgg

SEQ ID NO: 401559 - DNA, 867 bp, Homo sapiens
  misc_feature: GZ8MTXP01B59OT.21.25.C03.1.454.CMB.2.raw
  modified_base (277)..(277): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacgaccggagggcggctgcgtcagcacgagacgtcgggcccaggaccctgtgcagtgaggcgaggagagtggaggaggagaggacgaccgaggcagtgcgtggagtattcgtccgnggagtcgcgtcgtcccttgttcgtccgccccaagagtctagaaactccgaaggaccgtacccctaaccctaaactcctactaacttactaagtaacggtaaaccacgtaacgtaaccgtcccgggccccttaaacggggtacccgggggttcccctagggtaaaccccgtttactttcccgtaccgggttcgggtacccttaacccggtaagtttcccggtaccggtacccctaacccgttcccgtaacccggttacccccgtttccccgggttacggttacccgtacggttccccggtaccgggttcgggggttcccccttaacgggggacgggtttcccggtaaggtaaacccggggtagttacggggtaacgggttactttaaaggtttaaacttttaacggtttacgtttacccggaccgtttaaccggttacccgtttaaaggtaaccccgttaaacccgtaaacccggttccccggttttgggggtttacgggttttttcgggggtttttccgggcgggttttccgggggttacccgggggacccggggttaacccgggtaacccgttaacggggtttccccgg

SEQ ID NO: 401560 - DNA, 632 bp, Homo sapiens
  misc_feature: GZ8MTXP01A2X5N.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctcgcccgtggggccccagacgaccggagggcgctgcgtcagcacagacgtcgggcccaggaccctgtgcagtgagcgaggagagtggaaggaggagaggacgaccgaggccagtgcgtggagtagttgtccgtgagtcgcgtgccttcgttgccgcccagcgtctagaagcagaccgccctaaccaaactcctacatcgtagtacggtaaccagactacgtcccggtaccccgtcggaaccggggttcccagggtaaccctatttccgtcgtcggtcctacctacggtctcggcctaccgtcaccgtcccctccgtacgtccacgtccgcgtcgggcctcggggacggtcgtagacgtagtacggcgtgtaagttatttagttacgttccgacgtaactacgttataccgaaccgtaaccgtcccgttgggttccgtttgggtttcgcggttcgggtaccggcggggttacgaacgttaacggtccg

SEQ ID NO: 401561 - DNA, 605 bp, Homo sapiens
  misc_feature: GZ8MTXP01C8QHZ.21.25.C03.1.454.CMB.2.raw
  modified_base (271)..(271): a, c, t, g, unknown or other
  modified_base (340)..(340): a, c, t, g, unknown or other
  modified_base (576)..(576): a, c, t, g, unknown or other
  modified_base (599)..(599): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacgagacgtcgggcccaggaccctgtgcagtgagcgaggagagtggaaggaggagaggacgacaggccagtgcgtggagtattgtcngagtgctcgtcctcgttgtcgccccaagagtctaggaacgcgaagaccgtaccctacccaaactcctanaatctagtacgtaaacccagactaacgtccgacccgtacggacgggttcctagacccgttattcccgtcgtcggcctaccgtaagttcgacggacctacctccacggtcccttacccgtgtacctgtccgtcggtgggccctacggaacggtcgtacgacgtagtggagtcttagtaattatacgtcaccgtaagtaccttagtcaacgtaaccgtcgttggttcgtttggttcgngttcgggtcggaggccggtaacncgtccg

SEQ ID NO: 401562 - DNA, 670 bp, Homo sapiens
  misc_feature: GZ8MTXP01DEBR0.21.25.C03.1.454.CMB.2.raw
  modified_base (268)..(268): a, c, t, g, unknown or other
  modified_base (295)..(295): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacgagacgtcgggcccaggaccctgtgcagtgagcgaggagagtggaggaggagaggagacaggcatgcgtggagtatgtcgngagtcgctcgccttcgttgcgacccangctagagcaagcacctacaaactctacatcagtacgtaaccagactaacgcccggtaccctacgggacgggtccctaggtaacccgtattccgtccgtgggaccctacccgtaagttcctacggtacctaccgtcctacgtacccctccgtgtccacgtccgcgtacgggccctcggacggtccgttacggaacgtaggtggtaccgtagttaaggtattttaagttacgttccgtaccgtaacgttaccttaagtaaccgttaaacccgtaaaaccgtcccggttacggtttccgggttttcgggtttttaaccggcggtttccgggtttccgggggaccgggttacccgggaaccgttaacggttaaccccgg

SEQ ID NO: 401563 - DNA, 633 bp, Homo sapiens
  misc_feature: GZ8MTXP01CE0Y6.21.25.C03.1.454.CMB.2.raw
  modified_base (262)..(262): a, c, t, g, unknown or other
  modified_base (285)..(285): a, c, t, g, unknown or other
  modified_base (299)..(299): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctgggtccccagacaccggagggcggctgcgtcagcacagactgggcccaggaccctgtgcagtgagcgaggagagtgaggaggagaggagacagccatgctggagattgccngagtgctgcctcttgtcgcccanagctgaagcagacncctaccaaaactcctacatactaatggtaaaccacgcaaacgtcccggacccttaacgacggggtccctaggacccgtactttctcctcgggtacctacccgtaaagttccgtacggtcctaacccgtctacccgtcccttccccgtggtacccacgttccgtcgtcgggtcccttaccgggacggtctacggaccgagtcggagtccgttagtaatttattagttcgtcctaacggttaccttagtcgaaccgtaaacctccgttcggttcggtttcggttttcgggcgtttcgggttccggggcggggttaccgggaaccgaacggtcccgg

SEQ ID NO: 401564 - DNA, 709 bp, Homo sapiens
  misc_feature: GZ8MTXP01CS72O.21.25.C03.1.454.CMB.2.raw
  modified_base (303)..(303): a, c, t, g, unknown or other
  modified_base (341)..(341): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagacgtcgggcccaggaccctgtgcagtgagcggaaggagagtggaggaggagaggacgaccgaggccagtgcgtggagtattgtcctgagtgctcgccttcgttgtcgaccccanagtcaggaacgcaacggacgccctacccaaactcctanacttctagtacggtaaaccacgcaacgtcccggaccctaacgggtaccggggtccctagggaacccttatttcccgtcgtacgggacccttaccgaacgttcgtccggaccctacctccgacgtccccttccgtcggtcacgttcgccgtcgggtccctaccgggacggtccgtacggaacggtacgttcgggaacggttccgttaaggttaattttaaacgttcgtttacgacccgttaacggttacccttaaacgtaccgttaaacccgtaaaaccgtccccgttagggtttccgggttttacgggtttttcgggacgtttcgggttccggggccggttacccggggtaaccaacgggtaacccgg

SEQ ID NO: 401565 - DNA, 725 bp, Homo sapiens
  misc_feature: GZ8MTXP01CB33B.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactcgggcccaggacctgtgcagtgagcgaggagagtggaggaggagaggacgaccgaggccagtgcgtgggagtagttcggtcctggaggtcgcgttcggtcccttcgtttcggtcgacccccaagtacggccgtaggaacgccgaaggaccgtaccccttacccaaacttcctacgtaattaccgtagtacggtaaacccacggtacctaaacgtcccgggacccccttaacgggtacccggggttcccctacgggtacccgttactttccgtccgttacgggccctacccgtaacgttcgtacggtcctacccttccgaccgtccccttacccgtggtccacgttccgcgtcgggacctaccgggacggtcgtaggaccgtagtggacgtcttagtactttattacgttcgcctaacgtaccgttacgtcgttaaccgtaaccctcccggttacggttcggtttcgggtttttcgggtcggttccggggttaccgggggccggggaccgggtaacccgaacgggttaacccgg

SEQ ID NO: 401566 - DNA, 587 bp, Homo sapiens
  misc_feature: GZ8MTXP01BS1U3.21.25.C03.1.454.CMB.2.raw
  modified_base (264)..(264): a, c, t, g, unknown or other
  modified_base (287)..(287): a, c, t, g, unknown or other
  modified_base (318)..(318): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgctggagattgtccngagtgctgcctcttgtcgcccanagctagaagcagacgcctaccaaactcctanatctagtcggtaaccaggacaacgtccggcccctacggacggggtcccctagacccgtatttcctcgtcggcctacctagtctcggcctacctccgacgtccccttcccgtcggtccacgttccgcgtcgggccctaccgggacggtcgtacggacgtagtcggagtcttagtatttagttatcgctaacgtcttatacgaccaccgtcccgttggttcggtttggttttgcgttcgggttcgggcggttaccggtaaccaaggtcccg

SEQ ID NO: 401567 - DNA, 777 bp, Homo sapiens
  misc_feature: GZ8MTXP01BZIR2.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagtattgctgagtcgctgcctgttgcgcccangctagacgcagacgccctaccaaactcctacatactagtaggtaaacccagactaacgtcccggaccctaacgggacggggttcccctagaccccgttattcctacgtcgggtacccttacccgtaacgttccgtaccggtacccacccgttaccgtacccggtacccccgttccccggttgggttaccctaacgttcccgggtaccggttaccggggtccccgttaccgggggaaacggggttccgttaacgggaaaccggtaggttacgggtaacgggtttacttttaaacgtttaagtttaccgtttacgggtacccttaaccggttaacccttaacgttacccggaaacccttaaccccgttaacccggtttcgggtttccggggttttttcgggtttttcggggtcccggtttcgggggtttcccgggggacccgggggtaacccggggttaaccctaaacggggttccccggtttaaccccggg

SEQ ID NO: 401568 - DNA, 768 bp, Homo sapiens
  misc_feature: GZ8MTXP01AUR08.21.25.C03.1.454.CMB.2.raw
  modified_base (289)..(289): a, c, t, g, unknown or other
  modified_base (395)..(395): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctcgcccgtcggggccccagacaccggagggcggctgcgtcagcacgaggacgtcgggcccaaggccctggtgcaggtgagcggaaggagaggtaggagggaggaggaggacgaccgaggccagtgacgtaggagtattcgtccgnggacgtgtcctcgtacccttgttcggaccgccccaagaggcgtaggaacgcaacgaccgtcccctaacccaaacgttcctatacgtactaaaggtacggtaaaccncggtactaacggtcccgggaccccttacggggtaacccgggttccctagggtaacccttacgtttcccgtcggtacggtccttaccgtaacgtccgtacggaccctaccgtaccgacccgtcccgttccgttacggtcctacgttccggacggttcggggccctaccgggacgggtcccgttaaggacggtacgtcggtacggtcttaacgttagtttaacgttcgtaccgacccgttaacgttaccgttacgtaccgttaacccgttaaacccggttcccggtttgggtttcggggttttcggggttttcggcccggtttcggggtcccggggaccgggttacccgggtaaccgttaacggttaaccccggg

SEQ ID NO: 401569 - DNA, 583 bp, Homo sapiens
  misc_feature: GZ8MTXP01DN3GO.21.25.C03.1.454.CMB.2.raw
  modified_base (279)..(279): a, c, t, g, unknown or other
  modified_base (289)..(289): a, c, t, g, unknown or other
  modified_base (325)..(325): a, c, t, g, unknown or other
  modified_base (340)..(340): a, c, t, g, unknown or other
  modified_base (399)..(399): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaggagagtgaggaggagaggacgaccaggccatgctggagagttgtcctgagtgctgcctnttgcgcccangctgaaagctaagacgcccttaccgaaaactcctanaatctatacgtaacngcaacgtccggccctacgacggggtccctagacccgatttcacgttggctaccaagtcncgcaccgcacgtcctccctgggtacacgttcgcgttcgggcctcgggacggtcgtacgaccgagtcgaggtctaggtatttaacgttagttcgactcgttacttagtcgaaccaaacgtcccttggttcggtttgggttttcggcgttcgggttaccgggcggacggtaacccgaagggtcccg

SEQ ID NO: 401570 - DNA, 872 bp, Homo sapiens
  misc_feature: GZ8MTXP01BT6RB.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacgagacgtcgggcccaggaccctgtgcagtgagcgaggagagtgaggaggagaggagaccgaggcagtgcgtggagtattcgtccgtggagtcgtcgtcgtcctttacgttcggtccgaccccaaagacggtcctaagggaaacggcctaaaacgggacccgtacccccttaaaccccgtaaaaacctttccccttactaaagttacccgtaaaggtttaaccgggtaaaccacggtacctaaacggttccccggggaccccgttaaccggggtacccgggggttcccctagggtaaaccccgttgttttcccctaccggttcggggtacccttaacccgtaaacggtttcgtccgggacctaacccttccgacccgtcccccgttacccgttcgggtacctacgttccggtccggttcgggcccgttaccggggacgggtcgttacggaacggtaggtacgggtacggtcgtttaaggttattttaacgtttagttacccgtccggttaaacctttacccgttaagttaaacccgttaaaccgtaaaccccgttaccccgggttttgggtttcccggggtttttcgggggttttttccgggtacccggggtttttaaccggggtttccccgggggaacccgggggtttaccccgggaaaccggttaaaccgggtttaaccccgggg

SEQ ID NO: 401571 - DNA, 719 bp, Homo sapiens
  misc_feature: GZ8MTXP01AHQE2.21.25.C03.1.454.CMB.2.raw
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgctggagattcgtcctgagtgctgcctctgtcgccccanagcctagaaacgccaagacgcccctacccgaaaaccttccctacaacttctaagttcggggtaaaaacccccacggtacgtaaacgtccccggccccgtaacgggtaccgggggttcccctacggtacccgtacgtttcccgtcgtacggcccttaaccgtaacgtccgtacggtaccctacccgtccgtaccgtccccgtccgtacggttccacgttccgtaccggtcgggtccgtaccggggtacggtccgtacggaccgtaggtacggtacggtcgttacggttaatttacgttacgttcgacccgttaacgttaccgttacgtacgttaaaccgtaacccgtacccgttcggttcgggttttcgggttttcgggtccgtttcggggttccggggtaccgggttaccgggtaacccgttaacggtccg

SEQ ID NO: 401572 - DNA, 590 bp, Homo sapiens
  misc_feature: GZ8MTXP01A1NP0.21.25.C03.1.454.CMB.2.raw
  modified_base (281)..(281): a, c, t, g, unknown or other
  modified_base (291)..(291): a, c, t, g, unknown or other
  modified_base (299)..(299): a, c, t, g, unknown or other
  modified_base (305)..(305): a, c, t, g, unknown or other
  modified_base (320)..(320): a, c, t, g, unknown or other
  modified_base (336)..(336): a, c, t, g, unknown or other
  modified_base (366)..(366): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactgggcccaggaccctgtgcagtgagcgaggagagtgaggaggagaggagaccgaggccatgcgtggagtattgtcctgagtgctgccctnttgcgcccanagctgaancaggcncctacccaactccanatctagtaggtaaccngacaacgtccgccctaacggcgggttcccngacctattctcgtacggctacgagtctcgctcctcacgtccctccgtgtcacgttccgcgtgggcctccggggacggtcgtaggaccgtaagtcggaagtcgtagtatttattactcgaccctaagttccataccgaccgtaaacctcccggttggttccggtttgggttttccgggctttccggggttcggggccgggttacgggaacccgttaacggtcccg

SEQ ID NO: 401573 - DNA, 664 bp, Homo sapiens
  misc_feature: GZ8MTXP01EB23G.21.25.C03.1.454.CMB.2.raw
  modified_base (271)..(271): a, c, t, g, unknown or other
  modified_base (308)..(308): a, c, t, g, unknown or other
  modified_base (364)..(364): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccccgtggggccccagacaccggagggcggctgcgtcagcacagactgggcccaggaccctgtgcagtgagcgaggagagtggaggaggagaggagaccgaggccagtgctgggagtattgtccngagtgtctggccttcttgcgacccagagctaggaacncgagacgtcccctacccaaaaccttcctactacttacgtaagtacggtaaaccccngactaaacgtcccggacccctaaccggacggggtccctgaacccgtattccgtacgtcggaccttaccgtaacgtcgtcggacctaccgtcgaccgtcccctccgtgtcctacgtcgcgttacgggcccttacgggacggtcgtacgacgtagtggacggtcttagtatttagttacttccgccgtaaacgttccgttataccggaaccctaaaccgtacccgttgggttaccggttttcggggttttcggcggtttcgggttcccggggccggttaccgggtaaccgaacggttcccgg

SEQ ID NO: 401574 - DNA, 654 bp, Homo sapiens
  misc_feature: GZ8MTXP01DPGQG.21.25.C03.1.454.CMB.2.raw
  modified_base (332)..(332): a, c, t, g, unknown or other
tcagtcgtcgctcgcacgaccggtgctcgatttagtagtgtagatttgggtttggggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagccctccaaaactcctcactctatggtaaaccngcaatcggccctcagggggtcccctgaccgattctctggctccaagtcctggcaccctcgacgtccctccctcggttccaacttccggaccttgggggacccgttcccggacgggtaccttcggaaaccggaacgtttggaaacgggggtccttagggttaaatttacgttttaaatttcgggtacccctaaggttaccccttacgttacggttaccgaaaaaccctccccttacgggttaccggtttgggttttttggggttcccggttcgggtttcccgggggtacggggcccgggggttaaccccgaaacggtcccggg

SEQ ID NO: 401575 - DNA, 530 bp, Homo sapiens
  misc_feature: GZ8MTXP02GYVNX.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagacgcctaccaaactcctcatctatggtaaccagcaatccggccctcgacggggtccctgaccgtattcctcgtcggcctaccaacgtctcggccacctcacgtccctccctggtcacgtcgcgtcgggcctccgaggcgtgacgagtcggaggctgtattattagttcgcctacgtcctatcgacaactacctcgtcgttggtttgcgttcggttcggcggtcggaccgacgtcg

SEQ ID NO: 401576 - DNA, 411 bp, Homo sapiens
  misc_feature: GZ8MTXP02H9N7A.21.25.C03.1.454.CMB.2.raw
  modified_base (365)..(365): a, c, t, g, unknown or other
  modified_base (405)..(411): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttgctgttcggcggcgggacagctgaccgtctaggtcagccaaggcctcgccccctggtccactctcgtccccacctcctccgngccgacgaccgtgacgcggggctggccgaaggcgcatagnnnnnnn

SEQ ID NO: 401577 - DNA, 497 bp, Homo sapiens
  misc_feature: GZ8MTXP02JXCET.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctccaaactcctcatctatggtaaccagcaatcggccctcgaggggtcccctgaccgattctctggctccaagtctggcacctcacgccctccctggtcatcgctgggctccgaggctgacgatgaggctgattattatgcctagtcctatcgacaacaccctgtcgttggttttgcgttcgtcggcggcggacagtcg

SEQ ID NO: 401578 - DNA, 487 bp, Homo sapiens
  misc_feature: GZ8MTXP02GMQFX.21.25.C03.1.454.CMB.2.raw
  modified_base (284)..(284): a, c, t, g, unknown or other
  modified_base (357)..(357): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctccaaactcctcatctatggtaaccagcaatcggcctcaggggtccctgaccgattcnctggctccaagtctggcacctcagccctccctgtcatcgctcgggctccaggctgacgatcgaggctgattatattgcctagtcctatcgacaacacctgcgttggtttgctgtcggcgcggaccagtcg

SEQ ID NO: 401579 - DNA, 504 bp, Homo sapiens
  misc_feature: GZ8MTXP02GD2M7.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagacgcctaccaaactcctcatctatggtaaccagcaatccggccctcgacggggtccctgaccgattcctctggctccaagtctggcacctcacgccctccctggtcatcgctgggctccgaggctgacgatgaggctgattattatgcctagtcctatcgacaacaccctgtccgttggttttcgcttgttcggcggtcggaccagtcg

SEQ ID NO: 401580 - DNA, 553 bp, Homo sapiens
  misc_feature: GZ8MTXP02ILNY4.21.25.C03.1.454.CMB.2.raw
  modified_base (254)..(254): a, c, t, g, unknown or other
  modified_base (272)..(272): a, c, t, g, unknown or other
  modified_base (366)..(366): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagnttgcctgagtgctgcctnttgtgcccacagctgaagcagacgccctaccaaaactcctcatctaatggtaaacccagacaatccggccctcgaaggggtccctgaccattcnctgctcaagtctggcacctcacgccctccgtggtccagtccgcgtggggcctcccgaagggtctacggacgagtgagggtctagtattaatttagttcgaccctaacgtccttatcgaaacctaacctacccgtgtccgtttggttttcggcgttcggttcggcgggtaccgggaccgtaacgcccg

SEQ ID NO: 401581 - DNA, 510 bp, Homo sapiens
  misc_feature: GZ8MTXP02HEVCS.21.25.C03.1.454.CMB.2.raw
  modified_base (274)..(274): a, c, t, g, unknown or other
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccanagctgaagcagacgcctaccaaactcctcatctatggtaaccagcaatccggccctcgacggggtccctgaccgtattctctcggctccaagtctcggcacctcacgccctccctgtcatcgctgggctcgaggctgacgatgagctgtattattattgacctagtcctatcgaacaacctaccctgtcgttggtttgcgttcggttcggcggcggtacgagtcg

SEQ ID NO: 401582 - DNA, 491 bp, Homo sapiens
  misc_feature: GZ8MTXP02HN2PJ.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaaactcctcatctatggtaaccagcaatcggccctcaggggtccctgaccgattctctggctccaagtctggcacctcagcctccctggtcatcgctgggctccaggctgacgatgaggctgattattatgccagtcctatcgacaacaccctgtcgtggttttgcgtgttcggcggcggacaagtcg

SEQ ID NO: 401583 - DNA, 514 bp, Homo sapiens
  misc_feature: GZ8MTXP02HI8GN.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctaccaaactcctcatctatggtaaccagcaatccggccctcgacggggtccctgaccgtattctctggctccaagtctggcactcacgcctccctggtcatcgctgggcctccgaggtctgacgatgaggctgtattagttatgcctagtcctatcgaacaacacccgtgtccgttggttttggcttcggttcggcggtaccggactaacgtccg

SEQ ID NO: 401584 - DNA, 405 bp, Homo sapiens
  misc_feature: GZ8MTXP02F91T3.21.25.C03.1.454.CMB.2.raw
  modified_base (400)..(405): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcgggacagctgaccgtctaggtcagccaaggctcgccccctcggtccactctcgttccccaccctcctcctgcgacgactgagcgggctggcaaggcgcatagnnnnnn

SEQ ID NO: 401585 - DNA, 502 bp, Homo sapiens
  misc_feature: GZ8MTXP02GA92Z.21.25.C03.1.454.CMB.2.raw
  modified_base (273)..(273): a, c, t, g, unknown or other
tcagtcgtcgctcgcacgaccggtgctcgatttagtagtgtagatttgggtttgggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccacagctgaagcagagccctacaaactcctcatctatggtaaccagcaatccggccctcgacggggtccctgaccgtattcctctggctccaagtctggcacctcacgccctccctggtccagtccgcgtcgggcctccgaggctgacgatgagctgattatattgctagtcctatcgacaacacctgtcgttggtttgcttggtcggcggcggaccagtcg

SEQ ID NO: 401586 - DNA, 510 bp, Homo sapiens
  misc_feature: GZ8MTXP02JZQAG.21.25.C03.1.454.CMB.2.raw
  modified_base (285)..(285): a, c, t, g, unknown or other
  modified_base (359)..(359): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctccaaactcctcatctatggtaaccagcaatcggccctcaggggtccctgaccgattcnctggctccaagtctggcacctcacgccctccctggtcactcgcgtgggctccgaggctgacgatgaggctgattattattgcctagtcctatcgacaacctaccctagtcgttggttttggcgttggttcggcggtcgggaccgaagtccg

SEQ ID NO: 401587 - DNA, 525 bp, Homo sapiens
  misc_feature: GZ8MTXP02FW76H.21.25.C03.1.454.CMB.2.raw
  modified_base (284)..(284): a, c, t, g, unknown or other
  modified_base (326)..(326): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctaccaaactcctcatctatggtaaccngcaatcggccctcgacggggtccctgaccgtattcctctggcctcaagtctcggcacctcacgccctcccgtggtctacgtcgcgtcgggcctccgaggtctagacgtatgaggtctgtattattattgcctacgtcctatcgaacaactaccctgtcgttggttttcggcgttcggtcggcggtacggacctacgtcg

SEQ ID NO: 401588 - DNA, 514 bp, Homo sapiens
  misc_feature: GZ8MTXP02GM49B.21.25.C03.1.454.CMB.2.raw
  modified_base (326)..(326): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctaccaaactcctcatctatggtaaccngcaatccggccctcgacggggtccctgacccgtattcctctggcctccaagtctggcacctcacgccctccctggtcacgtcgcgtcgggctccgaggctgacgatgaggctgtattattattgcctagtacctatacgaacaacaccctgccgttggtttgcttggttcggcggtcggaccaagtcg

SEQ ID NO: 401589 - DNA, 544 bp, Homo sapiens
  misc_feature: GZ8MTXP02F91Y7.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagacgcctaccaaactcctcatctatggtaaccagcaatccggccctcgacggggtccctgaccgtattctctggctaccaagtctcggcacctcacgccctccctggtcactcgctcgggcctccgaggtctagacgagtcgaggtctagtattatttagtgtacctacgttcctaatcgaaccaactaccccgttgtcggtttgggttttcggcgttcggttcggggcggaccgggaccaacggtccg

SEQ ID NO: 401590 - DNA, 534 bp, Homo sapiens
  misc_feature: GZ8MTXP02H0M7F.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctctgtgcccacagctgaagcagagccctacaaactcctcatctatggtaaccagacaatccggcctcgacggggtccctgaccgtattcctctggcctaccaagtctcggcacctcacgtccctcccctggtccatcgcgtgggcctccgaggctgacgatgaggctagtattattatcgacctacgtctatacgaacaaacctaccctgtcgttgggttttcggtcgttcggttcgggccggtacgggtaccaaggtccg

SEQ ID NO: 401591 - DNA, 487 bp, Homo sapiens
  misc_feature: GZ8MTXP02JSTH0.21.25.C03.1.454.CMB.2.raw
  modified_base (387)..(387): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtgcccacagctgaagcagagcctccaaactcctcatctatggtaaccagcaatcggccctcaggggtccctgaccgattctctggctccaagtctggcactcagcctcccnggtcatcgctgggctccaggctgacgatgaggctgattatattgcagtcctatcgacaacacctgtcgtggttttggctgttcggcggtcggacaagtcg

SEQ ID NO: 401592 - DNA, 571 bp, Homo sapiens
  misc_feature: GZ8MTXP02IX1N4.21.25.C03.1.454.CMB.2.raw
  modified_base (284)..(284): a, c, t, g, unknown or other
  modified_base (366)..(366): a, c, t, g, unknown or other
  modified_base (401)..(401): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgcgcccanagctagaagcagacgccctaccaaactcctcatctaatggtaaccagcaatccggcctcgacggggtccctgaccgtattcnctggctcagtctgcactcacgcctccctggtaccncgtcgcgtcgggcctccgacggtctacggacgagtcggacggtctagtaactttattagtcgtacctacgttacctaacgtacgaaacctaaccgtaccgttacggttcggtttacgggtttcggtcggtttacgggttccgggaccgggtaccggtaaccgtaacgtcg

SEQ ID NO: 401593 - DNA, 493 bp, Homo sapiens
  misc_feature: GZ8MTXP02I81X3.21.25.C03.1.454.CMB.2.raw
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccanagctgaagcagagcctccaaactcctcatctatggtaaccagcaatcggcctcgaggggtccctgaccgattcctctggctccaagtctggcacctcagcctccctggtcatcgctgggctccgaggctgacgatgaggctgacttattattgcctagtcctatcgacaacaccctgcgttggtttgctgttcggcggcggacagtcg

SEQ ID NO: 401594 - DNA, 486 bp, Homo sapiens
  misc_feature: GZ8MTXP02FIYEF.21.25.C03.1.454.CMB.2.raw
  modified_base (349)..(349): a, c, t, g, unknown or other
  modified_base (359)..(359): a, c, t, g, unknown or other
  modified_base (385)..(385): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaaactcctcatctatggtaaccagcaatcggccctcaggggtcccngaccgattcnctggctccaagtctggcactcagccnccctgcatcgctgggctcaggctgacgatgagctgattatattgccagtcctatcgacaacaccctgcgttggtttggcttgttcggcggtcggaccagcg

SEQ ID NO: 401595 - DNA, 489 bp, Homo sapiens
  misc_feature: GZ8MTXP02HR1TQ.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctcaaactcctcatctatggtaaccagcaatcggcctcgaggggtccctgaccgattcctctggctccaagtctggcacctcacgccctccctgctcactcgcgtggctccgaggctgacgatgaggctgattattatgctagtcctatgacacacctgtcgttggtttgcgttcgtcggcggcggacacg

SEQ ID NO: 401596 - DNA, 567 bp, Homo sapiens
  misc_feature: GZ8MTXP02HT8UJ.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggagagaggagaccaggccatgctggagattgtcctgagtgctgcctctgtgcccacagctgaagcagagcctcaaaactcctcatctatggtaaccagcaatccggcctcgagggtccctgaccgtattcctcgtcggctcccgaagtctcggccaccgtcacgtccctccctggtcacgtcgcgtcgggcctccgacgggtcctggaccgagtggacggtcgtaggtatttaattagtttcgcctacgttacctatacgaacctaaacctcccgtggttccggtttgggtttttcggtcgttcgggtttccggggacggaccggggtaaccaaggtcccg

SEQ ID NO: 401597 - DNA, 539 bp, Homo sapiens
  misc_feature: GZ8MTXP02GU0D4.21.25.C03.1.454.CMB.2.raw
  modified_base (274)..(274): a, c, t, g, unknown or other
  modified_base (284)..(284): a, c, t, g, unknown or other
  modified_base (326)..(326): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgcgcccanagctgaagcagagccctaccaaactcctcatctatgtaaccngcaatccggccctacgacggggtccctgacccgtattccgtctcggcctacccaagtctggccacctcacgtccctcccgtggtcactcgcgtcgggctccgacggtctacggacgagtgaggtctagtaattattattcgacctacgtcctatcgaacaactacccgtgtcggttggtttcgcgttcggttcggcggtcggacgtacgtccg

SEQ ID NO: 401598 - DNA, 529 bp, Homo sapiens
  misc_feature: GZ8MTXP02FULA3.21.25.C03.1.454.CMB.2.raw
  modified_base (285)..(285): a, c, t, g, unknown or other
  modified_base (354)..(354): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccanagctgaagcagagcctaccaaactcctcatctatggtaaccagcaatccggccctcgacggggtccccngaccgtattcctctggctccaagtctcggcacctcacgccctccctcggtcactcgcgtcggcctccgacggctgacgatgaggctgtagttattattcgcctacgtcctattcgaacaacctacccgtcgtcgtttggtttcgtcgtcggttcggcggtcgggaccgacgtccg

SEQ ID NO: 401599 - DNA, 502 bp, Homo sapiens
  misc_feature: GZ8MTXP02HSGWO.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctgaagcagagcctccaaactcctcatctatggtaaccagacaatccggcctcgaggggtccctgaccattcctctggctccaagtctggcacctcacgtccctccctggtcactcgctcgggctccgaggtctggacgatcgagctgtattattatgcctagtcctatcgacaacacctgtcgttggtttgctgttcggcggcggtacacgtcg

SEQ ID NO: 401600 - DNA, 608 bp, Homo sapiens
  misc_feature: GZ8MTXP02HXXC8.21.25.C03.1.454.CMB.2.raw
  modified_base (286)..(286): a, c, t, g, unknown or other
  modified_base (448)..(448): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgctggagtattgcctgagtgctgcctcttgcgcccanagctaggaacgcaagacgccctaccaaacttcctacattactaagtacggtaaaccagaccaacgtcccgggcccttcggaacggggttcccctaggacccgtatttccgtcgtcggccttacccgaagtcgtcggaccacctcacgtccctcccgtgtccncgtcgcgtcggtcctcgcggtcgtagacgtagtggacgtcttagtaactttagttacgtcgtactacgttactaacgtacgtaacctaaccgtaccgttcggttcggtttcggtttcggtcggttacgggtccgggacggtaccggtaaccgtacggtcg

SEQ ID NO: 401601 - DNA, 614 bp, Homo sapiens
  misc_feature: GZ8MTXP02H54BD.21.25.C03.1.454.CMB.2.raw
  modified_base (271)..(271): a, c, t, g, unknown or other
  modified_base (282)..(282): a, c, t, g, unknown or other
  modified_base (523)..(523): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggaggagaggagacaggccatgctggagattgcctgagtgctgcctnttgtcgcccanagctgaagcagacgccctaccaaaactcctacaattcctaatggtaaaccagacaaacgtccggccctcgaacggggtcccctaggacccgatttccgtacgttcggcctacccgaaagttccgtaggacctacccttcgaaccgtcccttccccgtggtaccacgttccgccgtcgggccttccgacgggtctaggacgatggagtctagtaatttattagtcgacctacgtacccttanacgtaaaccaaaccgtaccccgttagtcccggtttgggtttttcggcgttcggtttccggggccggtacccgggtaacctaaacggtcccg

SEQ ID NO: 401602 - DNA, 527 bp, Homo sapiens
  misc_feature: GZ8MTXP02FM238.21.25.C03.1.454.CMB.2.raw
  modified_base (275)..(275): a, c, t, g, unknown or other
  modified_base (285)..(285): a, c, t, g, unknown or other
  modified_base (328)..(328): a, c, t, g, unknown or other
  modified_base (365)..(365): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccanagctgaagcagacgcctaccaaactcctcatctatggtaaccngcaatccggccctcgaggggtccctgaccgtattccncgtggcctccaagtctggcacctcacgccctccctggtcatcgcgtcgggcctccgacggctgacgagtgaggctgtatttattattgcctagtcctatcgaaccaacctacctcgtcgtttggtttggcgttcggttcggcggtacgggaccgaacgtccg

SEQ ID NO: 401603 - DNA, 505 bp, Homo sapiens
  misc_feature: GZ8MTXP02FICWM.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaaccagcaatcggcctcgaggggtccctgaccgattctctggctaccaagtctggcacctcacgccctccctggtcatccgcgtcggggctccgaggctgacgatgaggctgtattattattcgcctagtcctatcgactaaccaccttgtgttgttttggcttggttcggcggcggacagtcg

SEQ ID NO: 401604 - DNA, 495 bp, Homo sapiens
  misc_feature: GZ8MTXP02FRHD2.21.25.C03.1.454.CMB.2.raw
  modified_base (274)..(274): a, c, t, g, unknown or other
  modified_base (283)..(283): a, c, t, g, unknown or other
  modified_base (427)..(427): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtgcccanagctgaagcagacgcctaccaaactcctcatctatggtaaccagcaatccggcctcgacggggtccctgaccgtattcctctggctccaaagtctggcacctcacgccctcccgtggtcatcgctgggcctccgaggctgacgntcgagctgtattatatgcagtctatcgacacacctgcgttggtttgctggttcggcggcggacagtcg

SEQ ID NO: 401605 - DNA, 609 bp, Homo sapiens
  misc_feature: GZ8MTXP02HHZHQ.21.25.C03.1.454.CMB.2.raw
  modified_base (276)..(276): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgcctnttgtcgcccanagctagaagcagacgcctaccaaactcctacatctatacggtaaccagacaacgtccggccctcgacggggtccctaggaccgtattcctcgttcggccttaccgaaagttccgtacggaccctacccgtccaaccgtcccttcccgtcggtacctacgtccgcgtcggggtcccttccgaacgggtctaggaacgagtcggacggtctagtatttattagttcgacctagtaccctatacgaacctaaacctacccgtggtccggttttggttttcggtcgtttcggttccgggacggtaccgggaaccgtaacggtcccg

SEQ ID NO: 401606 - DNA, 501 bp, Homo sapiens
  misc_feature: GZ8MTXP02GU5U9.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattatcctgagtgctgcctcgttgtgccccacagctagaagcagagcctccaaaactcctcatctaatggtaaaccagcaaatccggccctcgaggggtccctagaccgtattctctggctccaagtctggcacctcacgtccctccctgtcatcgcgtcgggctcgagctgacgatcgagctgattatattgcagtcctatcgacaacacctgcgttgtttgctggttcggcgtacggacaagtcg

SEQ ID NO: 401607 - DNA, 506 bp, Homo sapiens
  misc_feature: GZ8MTXP02F23NX.21.25.C03.1.454.CMB.2.raw
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccanagctgaagcagacgcctaccaaactcctcatctatggtaaccagcaatccggccctcgacggggtccctgacccgtattctctggctccaagtctggcacctcacgccctccctggtcactcgctcgggctccgaggctgacgatcgagctgtattattattcgctacgtcctatcgacaacacctcgtcgttggtttgcgtgttcggcggtcggacagtcg

SEQ ID NO: 401608 - DNA, 537 bp, Homo sapiens
  misc_feature: GZ8MTXP02GUVBO.21.25.C03.1.454.CMB.2.raw
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagagccctaccaaactcctacatctatggtaaccagcaatccggccctcgacggggtcccctaggaccgtattcctcgtcggctacccaaagtctcggcacctcacgtccctcctggtcagtcgcgtgggctccgagtctgacgatgagctgtattattattcgcctacgtcctatacgtaacaacctacccgtgtcgtttggttttcggcgttcggttcggcggtacggacctaacggtccg

SEQ ID NO: 401609 - DNA, 570 bp, Homo sapiens
  misc_feature: GZ8MTXP02J3RDK.21.25.C03.1.454.CMB.2.raw
  modified_base (254)..(254): a, c, t, g, unknown or other
  modified_base (272)..(272): a, c, t, g, unknown or other
  modified_base (282)..(282): a, c, t, g, unknown or other
  modified_base (314)..(314): a, c, t, g, unknown or other
  modified_base (333)..(333): a, c, t, g, unknown or other
  modified_base (377)..(377): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccggaggcggctgcgtcagcacagactggcccaggaccctgtgcagtgagcgaggagagtgagggagagaggagaccaggccatgctggagnttgcctgagtgctgcctnttgcgcccanagctgaagcaagacgccctacaaaccttcctnatcctagtacggtaaaccngcaaacgtccggccctcggtacggggtcccctggaaccccgttnttccgtcgcggcctacccgaagttccgtcggcccaacccgtccgacgtccccgtcccgtggtcacgttcgcgtcgggcctccgaggttcagaccgtatggacggtctagtatttagttattcgactacgtacctatacgacaacgtcccgtgtcgtttggttttggcgtggttcggcggtaccggacagtccg

SEQ ID NO: 401610 - DNA, 498 bp, Homo sapiens
  misc_feature: GZ8MTXP02HSFW7.21.25.C03.1.454.CMB.2.raw
  modified_base (283)..(283): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtgcccanagctgaagcagagcctccaaactcctcatctatggtaaccagcaatccggcctcgacggggtccctgaccgattcctctggctccaagtctgcacctcacgcctcccctggtcatcgctgggctccaggctgacgatgagctgattatatgctagtcctatcgacaacaccctgtcgttggtttcgcttcggttcggacggtcggacctaagccg

SEQ ID NO: 401611 - DNA, 510 bp, Homo sapiens
  misc_feature: GZ8MTXP02HNFKQ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccacagctagaagcagagccctaccaaactcctcatctatggtaaccagcaatccggccctcgacggggtccctgaccgtattctcgtggctccaagtctggcacctcacgtccctcctggtcatcgctgggcctcacggtctgacatgagctgattatattgactagtcctatcgactaaccacctgtccgttggtttcgcttcggtcggcggtcggaccaagtccg

SEQ ID NO: 401612 - DNA, 496 bp, Homo sapiens
  misc_feature: GZ8MTXP02IWYUL.21.25.C03.1.454.CMB.2.raw
  modified_base (419)..(419): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctaccaaactcctcatctatggtaaccagcaatcggccctcgacggggtccctgaccgattctctggctccaagtctggcacctcacgcctccctggtcatcgctgggctccagctgacgntgaggctgattattatgcctagtcctatcgacacacctcgcgttggttttgcttcggttcggcggtcggacgagtcg

SEQ ID NO: 401613 - DNA, 504 bp, Homo sapiens
  misc_feature: GZ8MTXP02JY454.21.25.C03.1.454.CMB.2.raw
  modified_base (275)..(275): a, c, t, g, unknown or other
  modified_base (363)..(363): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccacagctgaagcagagcctaccaaactcctcatctatggtaacccagcaatcggccctcgacggggtccctgaccgattcnctcggctccaagtctggcacctcacgcctccctggtccatccgctgggcctccgaggctgacgtatgaggctgattattattcgctacgtcctatcgacacacctcgcgttggtttgctggttcggcggcggaccagtccg

SEQ ID NO: 401614 - DNA, 505 bp, Homo sapiens
  misc_feature: GZ8MTXP02FKYZU.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagcgcctaccaaactcctcatctatggtaaccagcaatcggccctcgaggggtccctgaccgtattctctggctcaagtctggcacctcacgccctccctggtcatcgcgtggggcctccgaggctgacgatcgaggctgattattattgccagtcctatcgacaacaccctgcgttggtttggcttcggttcggcggacggaccgagtcg

SEQ ID NO: 401615 - DNA, 602 bp, Homo sapiens
  misc_feature: GZ8MTXP02ICHJ2.21.25.C03.1.454.CMB.2.raw
  modified_base (275)..(275): a, c, t, g, unknown or other
  modified_base (280)..(280): a, c, t, g, unknown or other
  modified_base (285)..(285): a, c, t, g, unknown or other
  modified_base (428)..(428): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggatattgcctgagtgctgcctntgtcncccangctagaagcagacgcctaccaaactcctacatctataggtaaccagcaactccggccctcggaccggggtccctcgtaccgtactttctcgtacggcctaccaacgtctcggccctaccgtccacgtcccttccgtcggtacncgttcgcgtcggcctccgaggtctaggacgagtcggagtcttgtatttatactttcgaccctagttaccctaagttacgaaacctaaaccgttacccgtgggtttccggttttgggttttcggtccgtttacggggttccggggaccggggtaccggaaccgtaacggtcccgg

SEQ ID NO: 401616 - DNA, 591 bp, Homo sapiens
  misc_feature: GZ8MTXP02I6KQP.21.25.C03.1.454.CMB.2.raw
  modified_base (273)..(273): a, c, t, g, unknown or other
  modified_base (282)..(282): a, c, t, g, unknown or other
  modified_base (371)..(371): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctntgtcgccangctgaagcagacgcctaccaaactcctacatctagtacggtaaccagacaacgtccggccctacgacggggtccctagaccgtattccncgtggcctaccaagtcgtacggcctacctcacgtcccttcccgtgtcacgtcgcgtcgggcctccgaggtctcggaacgtagtgacggtcttagtaatttattacttcgacccgttacgttcccttaatacgtaaacctaaaccgtacccgttggttccggtttggggttttcggccgtttcggttccggggaccggtaccgggtaaccgtaacgtccgg

SEQ ID NO: 401617 - DNA, 504 bp, Homo sapiens
  misc_feature: GZ8MTXP02IP0IJ.21.25.C03.1.454.CMB.2.raw
  modified_base (284)..(284): a, c, t, g, unknown or other
  modified_base (380)..(380): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtgccccanagctgaagcagagccctaccaaactcctcatctatggtaaccagcaatcggccctcgacggggtccctgacccgtattcctcgtggcctcaagtcnggcacctcacgcctccctggtcactcgcgtggctccgaggctgacgatgagctgattagttatgctagtcctatcgacaacaccgtcgtcgttggtttcgcgtcggttcggcggcggacagtcg

SEQ ID NO: 401618 - DNA, 637 bp, Homo sapiens
  misc_feature: GZ8MTXP02G9JWO.21.25.C03.1.454.CMB.2.raw
  modified_base (275)..(275): a, c, t, g, unknown or other
  modified_base (278)..(278): a, c, t, g, unknown or other
  modified_base (284)..(284): a, c, t, g, unknown or other
  modified_base (292)..(292): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgngcccanagctgaancagacgcctaccaaactcctcatctatggtaaaccagcaatccggccctcgacggggtccctggacccgtattcctcgtggcctaccaagtctcggtccacctcacgtccctccctggtccactcgcgtggggcctccgacggtctacggaccgtaagtcggaacgggtctaggtaactttaatttacgttacgtcccgtaacggttacccgttaaacttacggtaaacccaaaacccgtaacccccgttcggttacccggttttaggggttttttcgggtccggtttacggggttttacccggggtccgggggtacccggggaacccgttaaaacggtccccgg

SEQ ID NO: 401619 - DNA, 499 bp, Homo sapiens
  misc_feature: GZ8MTXP02JCEPC.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtcgcccacagctgaagcagagcctccaaactcctcatctatggtaaccagcaatcggccctcgacggggtccctgaccgtattctctggctccaagtctggcactcacgcctccctggtcagtccgcgtcgggcctccgaggtctgacgagtgaggctgtattattatgcagtctatcgacacacctgtcgttggtttgcgtcgtcggcggcggtacagtcg

SEQ ID NO: 401620 - DNA, 604 bp, Homo sapiens
  misc_feature: GZ8MTXP02I02ID.21.25.C03.1.454.CMB.2.raw
  modified_base (292)..(292): a, c, t, g, unknown or other
  modified_base (385)..(385): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggaagaggacgacgaggcatgcgtggagtattcgtctgagtgctcgtccttgttgtccgcccanagtcgtagaacgcagacgccctaccaaactcctacatcctagtacgtaacacgaccacgtcccggcctacggtacggggtcctacgacccgtnttccgtcgtcggtcctaccgtaacgtcgtcggcctacctcacgtccctcccgtgtccacgtcgcgtcgggccctcgacggtcgtacggacgtagtacggagtcgtagttaatttacgttacgtcgaccgttacgtaccttagtacgtaaaccaaccgtacccgtggttccggtttgggttttcgcgttcgggttcggcgggtaccggacgtaacgtccg

SEQ ID NO: 401621 - DNA, 497 bp, Homo sapiens
  misc_feature: GZ8MTXP02GVIW8.21.25.C03.1.454.CMB.2.raw
  modified_base (286)..(286): a, c, t, g, unknown or other
  modified_base (315)..(315): a, c, t, g, unknown or other
  modified_base (329)..(329): a, c, t, g, unknown or other
tcagtcgtcgctcgcacgaccggtgctcgatttagtagtgtagatttgggtttggggtcgtgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagccctaccaaactcctnatctatggaaaccngcaatcggccctcgaggggtccctgaccgattcctctggctccaagtctcggcacctcagcctccctggtcatcgctgggctccaggctgacgatgagctgatttatatgcctagtcctatcgacaactacccgtgcgttggtttgcgtgtcggcggcggacaagtcg

SEQ ID NO: 401622 - DNA, 513 bp, Homo sapiens
  misc_feature: GZ8MTXP02F5CPA.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctccaaactcctcatctatggtaaccagcaatcggccctcgacggggtcccctgaccgtattcctctggcctccaagtctggcacctcacgccctccctggtcactccgcgtcgggcctccgacggtctgacgatgagctgtattattatcgctacgtcctatcgacaaccaccctgtcgttggtttgcgttggttcggcggtcggacacgtcg

SEQ ID NO: 401623 - DNA, 520 bp, Homo sapiens
  misc_feature: GZ8MTXP02FZPGB.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagacgcctaccaaactcctcatctatggtaaccagcaatccggccctcgacggggtccctgacccgattcctctggcctaccaaagtctggcacctcacgccctccctggtcatcgcgtgggcctccgaggctgacgatcgaggctgtattattatgctagtcctatcgaacaactacccgtgtcgttggttttggcgttcggttcggcggtcggaccgagtccg

SEQ ID NO: 401624 - DNA, 492 bp, Homo sapiens
  misc_feature: GZ8MTXP02FPM8P.21.25.C03.1.454.CMB.2.raw
  modified_base (458)..(458): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaaccagcaatcggccctcgacggggtccctgacccgattcctctggctccaagtctggcacctcacgccctccctggtcatcgctgggctccaggctgacgatgaggctgattattattgctagtcctatcgacaacncctgcgttggtttgctgttcggcgcggacagtcg

SEQ ID NO: 401625 - DNA, 690 bp, Homo sapiens
  misc_feature: GZ8MTXP02HP4BH.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtgccccanagctgaagcagacgccctaccaaactcctacattctataggtaaccagacaagtccggccctcgacggggtcccctagacccgtatttccgtcgtcggcctacccgaacgttccgtcggccctaccctcctacgtccccttccccgtgggtccacgttccgccgttcggggcccttcccgacgggtccgttacggaccggtagttacggaacgggtccgttaggttaacttttaatttaacgtttcgtacccgttaacggttaccctttaacgttacggaaaccctaaaacccgttaccccgttcgggtttaccgggttttcgggggttttttcgggtccggttttcggggttttcccgggggaccggggtacccgggggttaaaccccgaaacgggtttccccgg

SEQ ID NO: 401626 - DNA, 602 bp, Homo sapiens
  misc_feature: GZ8MTXP02H04CT.21.25.C03.1.454.CMB.2.raw
  modified_base (314)..(314): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagtgaggaggagaggagaccgaggccatgctggagattgcctgagtgctgcctcttgtcgccacagctgaagcagagccctacaaaactcctanatctatggtaaccagacaatccggcctcgacgggtccctgaccgtacttccgtcgtcggcctaccaaacgttccgtggccctacccttccaaccgtccccttcccgttcgggtacctacgtccgccgtcgggccttccgacgggtctaggaccgtagtggacggcttagtattattaagttcgaccttacgttcccttaagtacgaacctaaaccgtacccgtcggttcgtttgggtttttcggcgtttcggtttcggggccgggtaccgggaacctaacggtcccgg

SEQ ID NO: 401627 - DNA, 576 bp, Homo sapiens
  misc_feature: GZ8MTXP02HBI29.21.25.C03.1.454.CMB.2.raw
  modified_base (275)..(275): a, c, t, g, unknown or other
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgcgtggagattgcctgagtgctgcctnttgcgcccangctagaagcagacgccctacccaaactcctcattctagtggaaccagcaagtccggcctcgacggggtccctacgaccgtacttcctcgtcggacctccgaaacgtccgtcggacctacccgtccaccgtcccttccccgtcggtccacgtccgcgtcgggcctaccgacggtcgtacgacgtagtcggagtctagtattattagtcgcctacgtcctagtacgaaccaacctccgtacgtcgtttggtttcggtcgttcgggttcggcgggtaccggaccgtacggtccg

SEQ ID NO: 401628 - DNA, 544 bp, Homo sapiens
  misc_feature: GZ8MTXP02I3XCL.21.25.C03.1.454.CMB.2.raw
  modified_base (273)..(273): a, c, t, g, unknown or other
  modified_base (283)..(283): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgctgagtgctgcctnttgtgcccanagctgaagcagacgccctaccaaactcctcatctaatggtaaccagacaatccggccctgacggggtccctgaccgtattcctctggctccaagtcgtgccacctcacgccctcccgtggtccatccgcgttcgggcctccgaggtctagacgagtcgaggctagtattattatcgcctacgtcctatcgaacaacctacccgtcgtcggtttcggttttcggcgttcggttccgggcggtaccgggtaccgaacggtccg

SEQ ID NO: 401629 - DNA, 514 bp, Homo sapiens
  misc_feature: GZ8MTXP02HS4RJ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctacaaactcctcatctatggtaaccagcaatccggcctcgacggggtccctgacccgattcctctcggctccaagtctggcacctcacgtccctccctggtccatcgcgtcgggcctccgaggctgacgacgtggagctgattattattgcctacgtcctatcgacaaccacctcgtcgttggtttgcttcggttcggcggcggacgaagtccg

SEQ ID NO: 401630 - DNA, 538 bp, Homo sapiens
  misc_feature: GZ8MTXP02JQIUG.21.25.C03.1.454.CMB.2.raw
  modified_base (273)..(273): a, c, t, g, unknown or other
  modified_base (282)..(282): a, c, t, g, unknown or other
  modified_base (324)..(324): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctntgtgcccanagctgaagcagacgcctaccaaactcctcatctatgtaaccngcaatccggccctcgacggggtccctgaccgtattcctcgtcggcctaccaagtctcggccacctcacgccctcccgtcggtcatccgcgtcggcctccgacggtctagacgatgaggtctgtattattactactacgtcctatcaactaaccaccgtcgtcgtttggttttcggcgttcggttcggcgggtaccggaccgtacgtcgtaccgg

SEQ ID NO: 401631 - DNA, 555 bp, Homo sapiens
  misc_feature: GZ8MTXP02JN0SD.21.25.C03.1.454.CMB.2.raw
  modified_base (285)..(285): a, c, t, g, unknown or other
  modified_base (371)..(371): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggaggagaggagaccaggccatgctggagattgtcctgagtgctgcctcttgtcgcccanagctagaagcagacgccctaccaaactcctacatctatggtaaccagcaatccggccctcgacggggtcccctgacccgtattccncgtggcctccaagtctggccacctcacgccctccctggtccatccgcgtcggggcctccgacggtctaggaccgagtgacggtctggtaatttatttagttcgacctacgtcctatcgaaaccaaacctacccgtcgtccggttggttttcggcgttcggttcgggcggcggtaccgaagtccg

SEQ ID NO: 401632 - DNA, 539 bp, Homo sapiens
  misc_feature: GZ8MTXP02HKKM1.21.25.C03.1.454.CMB.2.raw
  modified_base (287)..(287): a, c, t, g, unknown or other
  modified_base (316)..(316): a, c, t, g, unknown or other
  modified_base (390)..(390): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccanagctgaagcagacgcctaccaaactcctnatctatggtaaccagcaagtccggccctcgacggggtcccctgaccgattcctctggcctccgaagtctggccncctcacgccctcccgtgtcatcgctcgggctccgaggctgacgatgaggtctgtacttattagtcgcgtacgtctatcgaaacctaaccaccgtgtcggtttcggttttcggtcgttcgggttcgggcggtaccgggaaccacggtccg

SEQ ID NO: 401633 - DNA, 526 bp, Homo sapiens
  misc_feature: GZ8MTXP02GTY2L.21.25.C03.1.454.CMB.2.raw
  modified_base (275)..(275): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtgcccanagctgaagcagacgcctaccaaactcctcatctatggtaaccagcaatccggccctcgacggggtcccctgacccgtattcctctggcctaccgaacgtctcggccacctcacgccctcccgtcggtcactcgcgtcgggcctccgaggtctgacgatcgaggctgtattattatgcctacgtcctatcgacaaccaccgtgtcgtttggtttgcgttcggttcggcggtcggaccacgtcg

SEQ ID NO: 401634 - DNA, 602 bp, Homo sapiens
  misc_feature: GZ8MTXP02HWGQ2.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtcgcccacagctagaagcagacgcctaccaaactcctacatctagtaggtaaccagaccaagtccggccctcgacggggtcccctggacccgtatttccgtcgtcggcctacccgaacgttccgtcggccctaccctccgaccgtcccctcccgtggtaccacgttcgcgtcgggcctccgacggcctaggacgagtggacggctagtatttagttagttcgcctacgtccttagtacgaaccaacctacccgttcggttccggtttgggtttttcggtcgttcgggtttccggggcgggtacccgggtaaccgtaacggtccgg

SEQ ID NO: 401635 - DNA, 603 bp, Homo sapiens
  misc_feature: GZ8MTXP02I93GB.21.25.C03.1.454.CMB.2.raw
  modified_base (254)..(254): a, c, t, g, unknown or other
  modified_base (272)..(272): a, c, t, g, unknown or other
  modified_base (281)..(281): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctgganattgctgagtgctgcctntgcgcccanagctgaaagcagacgccctaccaaactcctacatctaagtcggtaaaccagaccaacgtccggaccctacggaacggggttccccctaggacccgtatttccgtcgttcggcctacccgaaagttccgttacggaccctaacccgttcgaacgtccccttaccccgttgggtacctacgttccgcgttcgggcctccgaggtctacggacgagtcggacggtctaggtaatttattagtcgacctacgtcctaatcgaaacctaaactcccgtggtcggtttggtttcggcttcggttccgggcggtacggacgtacgtccg

SEQ ID NO: 401636 - DNA, 532 bp, Homo sapiens
  misc_feature: GZ8MTXP02G4TEE.21.25.C03.1.454.CMB.2.raw
  modified_base (286)..(286): a, c, t, g, unknown or other
  modified_base (452)..(452): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctaccaaactcctcatctaagtcggtaaaccagacaagtccggccctcgacggggtccctgaccgtattcctctcggcctaccgaagtcctcggccacctcacgtccctcccgtggtccacgtcgcgtcgggcctccgaggtctgacgagngaggctgatttatatcgctacgtcctatcgaacaaccacctgtcgttggtttgcttcggtcggcggtcggaccgagtccg

SEQ ID NO: 401637 - DNA, 547 bp, Homo sapiens
  misc_feature: GZ8MTXP02HLXXP.21.25.C03.1.454.CMB.2.raw
  modified_base (281)..(281): a, c, t, g, unknown or other
tcagtcgtcgctcgcacgaccggtgctcgatttagtagtgtagatttgggtttggggctgttcctggaagttgctgataccagtgcacatcaaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccagtcgctggagattgtcctgagtgcgtgcctcgtgngcccacgagcgtagaacgcgtaagcgcctaccaaactctacatctatggtaaccagacaagtccggcctcgacggggtccctgaccgtattctcgtcgcttaccaagtcgtgacaccgtcacgtcctcccgtggtcatccgcgtcgggacctccgaggctcgacgactgacggtctagtattacttagttcgactacgtcctatacgacaaacctccgtcgtcgttggtttcgtcgttcggttacggcggtaccggacaacgtccg

SEQ ID NO: 401638 - DNA, 598 bp, Homo sapiens
  misc_feature: GZ8MTXP02JRW5I.21.25.C03.1.454.CMB.2.raw
  modified_base (273)..(273): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgctgagtgctgcctnttgtcgcccanagctgaagcagacgccctaccaaaactcctacactctaataggtaaacccagacaaactccgggacccctcggaacggggtcccctaggaaccgtactttccgtcgttcggggccttacccgaaacgttccgtcgggccctaacccgttcgaaccgtcccttccccgttcgggtcctacgttccgcgttcggggcccttccgacgggtcctaggaccgtagtgaacgggtctagtatttagtattcgacctacgtcctatcgaacaacacccgtgtcgttggtttcgcgttcggtcggtcggcggtacacgtcg

SEQ ID NO: 401639 - DNA, 526 bp, Homo sapiens
  misc_feature: GZ8MTXP02JY6I3.21.25.C03.1.454.CMB.2.raw
  modified_base (273)..(273): a, c, t, g, unknown or other
  modified_base (283)..(283): a, c, t, g, unknown or other
  modified_base (443)..(443): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgcctgagtgctgcctntgtcgcccanagctgaagcagacgcctaccaaactcctcatctaatggtaaaccagcaagtccggccctcgacggggtccctggaccgtattctcgtcggcctaccaagtccgtggccacctcacgtccctcccgtggtcacgtcgcgtcgggcctccgaggctggacgntgaggtctgtacttattatcgctacgtcctatcgaccaacacctcgtcgttggtttgcgttcggtcggcggtcggacacgtcg

SEQ ID NO: 401640 - DNA, 521 bp, Homo sapiens
  misc_feature: GZ8MTXP02F1ECN.21.25.C03.1.454.CMB.2.raw
  modified_base (255)..(255): a, c, t, g, unknown or other
  modified_base (274)..(274): a, c, t, g, unknown or other
  modified_base (285)..(285): a, c, t, g, unknown or other
  modified_base (479)..(479): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtctgagtgctgcctnttgtcgcccanagctgaagcagacgccctaccaaactcctacatctatggtaaccagacaagtccggccctcgacggggtcccctgaccgtattcctcgtcggctccaagtctggccacctcacgtccctcccgtggtcacgtcgcgtgggcctcgaggctgacgatcgaggctagtattatatgcctacgtctatcgaacaacnccgtgtcgtttggtttgcgtcggttcggcggtcggacagtcg

SEQ ID NO: 401641 - DNA, 536 bp, Homo sapiens
  misc_feature: GZ8MTXP02GSI27.21.25.C03.1.454.CMB.2.raw
  modified_base (284)..(284): a, c, t, g, unknown or other
  modified_base (315)..(315): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgcgcccanagctgaagcagacgccctaccaaactcctanatctatggtaaaccagacaatccggccctcgacggggtccctgaccgtattcctcgtggcctaccaagtctggccacctcacgtccctcccgtggtcacgtcgcgtgggcctccgaggctagacgatgaggctagtattattatgcctagtcctatacgaacaacctacccgtgtccgtttggtttcgcgttcggttccgggcggtccgggaccacgtccg

SEQ ID NO: 401642 - DNA, 508 bp, Homo sapiens
  misc_feature: GZ8MTXP02J0AC5.21.25.C03.1.454.CMB.2.raw
  modified_base (352)..(352): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaaccagcaatccggccctcgacggggtccccngacccgattcctctggcctccaaagtcctggccacctcacgcctccctggtccacgtcgctcgggctaccgaggctgacgatgaggctgattattattgcctagtcctatcgacacaccctgcgttggtttgctggttcggcggtcggacagtccg

SEQ ID NO: 401643 - DNA, 556 bp, Homo sapiens
  misc_feature: GZ8MTXP02H5A0E.21.25.C03.1.454.CMB.2.raw
  modified_base (314)..(314): a, c, t, g, unknown or other
  modified_base (330)..(330): a, c, t, g, unknown or other
  modified_base (383)..(383): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggcccccagacaccgagggcggctgcgtcagcacagactgggcccaggaccctgtgcagtgagcgaggagagtgaggaggagaggagaccaggccatgctggagattgcctgagtgctgcctcttgtcgcccacagctgaaagcagacgcctaccaaactccncatctatcggtaaccngacaatccggccctgacggggtccctagaccgtattctctggcctccaagtcncggccacctcacgtccctccctggtccacgtcgcgtcggcctccgacggctgacgtagtaggaggtacgttgatttaattagtcgtcctacgtccttaatacgaaaccaaacctacccgtcgtccgtttggttttcggcgttcggttccggggcggtccggacgtaacggccg

SEQ ID NO: 401644 - DNA, 539 bp, Homo sapiens
  misc_feature: GZ8MTXP02GB3VU.21.25.C03.1.454.CMB.2.raw
  modified_base (262)..(262): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagatgtccngagtgctgcctcttgtgccccanagctgaaagcagcgcctaccaaactcctcatctaatggtaaccagcaatccggccctcgacggggtccctgaccgtattcctcgtcggcctaccaaagtcctggccacctcacgccctccctggtcactcgctgggcctccgacggctgacgatcgagctagattattagtgacctagtcctatacgtacaactacccgtgtccggtttggtttcggtcgttcggttccgggcggtaccgggaccaacggtccg

SEQ ID NO: 401645 - DNA, 564 bp, Homo sapiens
  misc_feature: GZ8MTXP02HKYS3.21.25.C03.1.454.CMB.2.raw
  modified_base (272)..(272): a, c, t, g, unknown or other
  modified_base (281)..(281): a, c, t, g, unknown or other
  modified_base (346)..(346): a, c, t, g, unknown or other
  modified_base (355)..(355): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagatgcctgagtgctgcctntgtgcccanagctgaagcagacgcctaccaaactcctcatctatggtaaccagcaatcggcctcaggggtcccngacgattcnctgctccaagtctgcaccgtcacgcctccctggtcagtccgcgtcgggccttccgagggtcctaggacgtatcggaacggtctaggtactttaattacgttagacctacggtacccttagtacgaaaccaaacctacccgttggtccgttttgggtttttcggcgtttcggtttccggggccgggtaccggggtaaccaaacggtccgg

SEQ ID NO: 401646 - DNA, 665 bp, Homo sapiens
  misc_feature: GZ8MTXP02GDBYX.21.25.C03.1.454.CMB.2.raw
  modified_base (258)..(258): a, c, t, g, unknown or other
  modified_base (289)..(289): a, c, t, g, unknown or other
  modified_base (322)..(322): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccatgctgganattgtcctgagtgctgcctcttgtcgcccanagctagaagcagacgaccctaccaaactcctanatctaagtcggtaaacagacaaagtccggaccctcgaacggggtccctgaaccgtatttcctcgtggcctacaacgtctcggccacctcacgtccctcccgtcggtacctacgtccgtcgtcggggccctccggtaacgggtccgttaggaaaccggtagtacgggaacgggtccttaaggttaattttaacgttacgtttaccggaccctaacggtttacccttaaagttaccgaaaaccttaaaacccgtccccgtttaggtccgggttttggggtttttcgggccggtttcggggtttccgggggaccgggtaccgggggaaaccgtaacggttcccggg

SEQ ID NO: 401647 - DNA, 525 bp, Homo sapiens
  misc_feature: GZ8MTXP02HBM4M.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccacagctgaagcagacgcctacccaaactcctcatctaatggtaacccagcaagtccggccctcgacgggtccctgaccgattctctgcctccaagtctggcacctcacgcctccctggtcagtcgcgtgggcctccgaggtctggaccgatgacggctagtattattattgcctacgtcctatcgacaaccaccgtcgtcgtttggttttcgcgtcggttcggcggtcggaccgaacgtcg

SEQ ID NO: 401648 - DNA, 532 bp, Homo sapiens
  misc_feature: GZ8MTXP02F3VPE.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagacgcctccaaactcctcatctatggtaaccagcaatccggccctcgacggggtccctgaccgtattcctctggcctcaagtctggcacctcacgccctccctggtcatcgctcgggctccgacggctgacgatgaggctgtattattattcgcctacgtcctatacgacaactacccgtagtccggtttggttttcggtcgttcggttcgggcgggtaccgggaccgtaacggtccg

SEQ ID NO: 401649 - DNA, 557 bp, Homo sapiens
  misc_feature: GZ8MTXP02F40YL.21.25.C03.1.454.CMB.2.raw
  modified_base (291)..(291): a, c, t, g, unknown or other
  modified_base (305)..(305): a, c, t, g, unknown or other
  modified_base (420)..(420): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgcgtaggagtattgtcctgagtgctgccttctgtcgcccangctagaagcagacncctaccaaactcctacatctagtacggtaacagacaacgtccggccctacggacgggtccctgaccgtattctcgtgcctacgaagtcgtcgcacctcgcgtccctccgtgtacncgtccgcgttacgggctaccgacggtctacgacgtagtcgaggtctagttaatttagttagtcgactacgtactagtacgaacctactaccgtgtcggtttgtttcggcgttcggtcggcggaccgtacgacgtccg

SEQ ID NO: 401650 - DNA, 638 bp, Homo sapiens
  misc_feature: GZ8MTXP02GAFOO.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctagaagcagacgccctaccaaactcctacatctaatggtaaccagccaaagtccggccctcgaacggggtccctacgaccgtatttcctcgtcggaccttaccgaaacgttccgtggacctaccctcgacgtcccctccccgtggtacacgtccgtcgtcgggcctccgacgggtctggacgagttcggaggtcgttagtaatttagttaacgtttcgacctacgttaccctttaaagaccgtaaaacctaaaaccgtacccccgttgggttaccggttttcggggtttttcggccgttttacggggtttcccggggccgggtaccggggtaacccgaaagggtcccgg

SEQ ID NO: 401651 - DNA, 686 bp, Homo sapiens
  misc_feature: GZ8MTXP02GW1BA.21.25.C03.1.454.CMB.2.raw
  modified_base (277)..(277): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgctggagattgtacctgagtgctgcctnttgtcgcccanagctagaagcagacgcctaccaaactcctacattcctatacggtaaccagacctaacgtccggcccctgaaccggggtccctacggaccgtacttccgtacgtcgggtcctacccgtaaagttccgtcggtccacccgtccgaaccgtccccttccccgtcgggtacctacgttccggccgttcgggtcccttcccggaacggtcgttacggaccggtaagtcggaaacggtcttaggttaatttacgtttaacgttcgacccttacggttaccttacgttaccggaaacctaaaacccgttacccgttacgggttacggtttttacggggttttcggtccgtttacgggtttcccggggaccggggtacccggggtaacccgtaacggttccccggg

SEQ ID NO: 401652 - DNA, 579 bp, Homo sapiens
  misc_feature: GZ8MTXP02HQJDL.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccacagctgaagcagacgcctaccaaactcctacatctatggtaaccagcaatccggccctcgacggggtccctgacccgtattcctctcggcctaccgaagtcctcggccaccctcacgtcccctcccgtggtccacgtccgcgtcgggcctccgaggtctgacgatgaggtctgtattattagttcgacctagttacctagtacgtaaccaaacctacccgtcgtcggtttcggggtttttcggtccgtttcgggtttccgggaccgggtaccggggtaaccgtaacggtcccgg

SEQ ID NO: 401653 - DNA, 512 bp, Homo sapiens
  misc_feature: GZ8MTXP02GX0D6.21.25.C03.1.454.CMB.2.raw
  modified_base (274)..(274): a, c, t, g, unknown or other
  modified_base (283)..(283): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtgcccanagctgaagcagagcctaccaaactcctcatctatggtaacccagcaatccggccctcgacggggtccctgaccgtattcctcgtggcctccaagtctggcacctcacgccctccctggtcactccgcgtcgggcctccgaggctgaccgatgaggtctgtatttattattgcctagtcctatcgacaacaccctgtcgttggtttgcttcggtcggcggcggacagtcg

SEQ ID NO: 401654 - DNA, 523 bp, Homo sapiens
  misc_feature: GZ8MTXP02HOVMZ.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgaggtcggctgcgtcagcacagactgggcccaggaccctgtgcagtgagcgaggagagtgaggaggagaggagaccaggccatgctggagattgtcctgagtgctgcctcttgtgccccanagctgaagcagacgcctaccaaactcctcatctatggtaaccagcaatccggccctcgacggggtccctgaccgtattcctctggcctccaagtctcggcacctcacgtccctccctggtcacgtcgcgtcgggcctccgaggtctgacgagtgaggtctagtatttattattcgctacgtcctatcgacaactaccgtcgtcgttggtttgcgttcgttcggcggcggacacgtcg

SEQ ID NO: 401655 - DNA, 596 bp, Homo sapiens
  misc_feature: GZ8MTXP02HMXND.21.25.C03.1.454.CMB.2.raw
  modified_base (285)..(285): a, c, t, g, unknown or other
  modified_base (292)..(292): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgagagagtgaggaggagaggagaccaggccagtgctggagattgtcctgagtgctgcctcttgtcgcccangctgaancagacgcctaccaaactcctacatctagtaggtaaccagacaacgtccggccctacggacggggtccctaggaccgtattccgtcgtcggacctaccgaacgtctcggccacctcacgtccctccgtcgtcagtcgcgttcgggccttcgaggtcctagtacgagtggacggtctagtaatttacttagttcgaccctacgttaccctaagtacgtaaccaaaaccgtccccgtaggttccgttttggggtttttcgccgtttacgggtttccggggcggtaccgggtaccgtaaggtccccgg

SEQ ID NO: 401656 - DNA, 497 bp, Homo sapiens
  misc_feature: GZ8MTXP02IAE6Y.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtgcccacagctgaagcagagcctccaaaactcctcatctatggtaaccagcaatcggccctcaggggtccctgaccgattctctggctccaagtctggcacctcacgcctccctggtcatcgcgtggctccagctgacgatgagctgattattattgcctacgtcctatcgacaaacaccctcgtcgttggttttgcgtgttcggcggtcggaccaagtcg

SEQ ID NO: 401657 - DNA, 526 bp, Homo sapiens
  misc_feature: GZ8MTXP02JISKT.21.25.C03.1.454.CMB.2.raw
  modified_base (255)..(255): a, c, t, g, unknown or other
  modified_base (278)..(278): a, c, t, g, unknown or other
  modified_base (370)..(370): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggcgaccgtctgccctggggccccagacaccgagggcggctgcgtcagcacagactgggcccaggaccctgtgcagtgagcgaggagagtgaggaggagaggagaccaggccatgctgganattgcctgagtgctgcctcttgngcccacagctgaagcagacgcctaccaaactcctacatctataggtaacccagcaaatccggccctgacggggtccctagacccgtattccnctggctaccaagtctggcacctcacgccctccctggtcactcgcgtcgggcctccgacggtctgacgtagtggaggtctagtaatttattattcgcctagtcctagtacgaacaactaccctgtcgttgtttgctcggttcggcggcgaccagtcg

SEQ ID NO: 401658 - DNA, 537 bp, Homo sapiens
  misc_feature: GZ8MTXP02GT52M.21.25.C03.1.454.CMB.2.raw
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccanagctgaagcagacgcctaccaaactcctcatctatgtaaccagcaatccggccctcgacggggtccctgaccgattctcgtggcctccaagtctggccacctcacgccctcccgtggtcactcgcgtcgggcctccgacggctggacgagtgaggtctgtatttattactcgcctacgtcctatacgaacaacctacccgtcgtcgtttggttttcggcgttcggttcggcggtaccggtaccgaagtccg

SEQ ID NO: 401659 - DNA, 541 bp, Homo sapiens
  misc_feature: GZ8MTXP02F2J16.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagagcctacaaactcctcatctatggtaaccagcaatccggccctcgacggggtccctgaccgtattcctctggcctccaagtctcggcaccgtcacgtccctccctggtaccagtccgcgtcggggcctccgacggtctggaaccgatacggaggtctagtaatttattagtcgtacctagttccctatcgaacaaccacctcgtcgtttggtttcgcttcggttcggcggtcggaccgaagtccg

SEQ ID NO: 401660 - DNA, 523 bp, Homo sapiens
  misc_feature: GZ8MTXP02JDLEP.21.25.C03.1.454.CMB.2.raw
  modified_base (283)..(283): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctctgtgcccanagctgaagcagacgcctaccaaactcctcatctatggtaaccagcaatccggccctcgacggggtccctgacccgtattcctctggcctccaagtctggcacctcacgccctccctggtcacgtccgcgttcgggcctccgaggctggacgatggagctgtattattagtgcctagttcctatcgaacaacctacccttgccgttggtttcgcgttcggttcgggcggccggacagtccg

SEQ ID NO: 401661 - DNA, 499 bp, Homo sapiens
  misc_feature: GZ8MTXP02GQXDW.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgctcttgtgcccacagctgaagcagagcctccaaactcctcatctatggtaaccagcaatcggccctcaggggtccctgaccgattcctctggctcaaagtctggcacctcagcctccctgtcatcgctgggctccaggctgacgatgaggctgattattattgcctagtcctatcgaacaacaccctgcgttggttttggcgttcgttcggcggacgggaccaagtccg

SEQ ID NO: 401662 - DNA, 593 bp, Homo sapiens
  misc_feature: GZ8MTXP02IR6YC.21.25.C03.1.454.CMB.2.raw
  modified_base (272)..(272): a, c, t, g, unknown or other
  modified_base (282)..(282): a, c, t, g, unknown or other
  modified_base (325)..(325): a, c, t, g, unknown or other
  modified_base (368)..(368): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgctgagtgctgcctntgtcgcccangctgaagcagacgcctaccaaactcctcatctatggtaaaccngacaatccggccctacgacggggtccctagacccgtatttccncgtggcctccaagtctggcacctcacgccctccctcggtcacgtcgcgtcgggcctccgacggtcgtcggacgagtgacggtcttagtaatttatttaacgttcggtacctacggttacccttaagttacgaaacctaaacctacccgtcggttccggtttgggtttttcggtcgtttcggggtttccggggtaccgggtaccggggtaccgtaaacggtcccgg

SEQ ID NO: 401663 - DNA, 505 bp, Homo sapiens
  misc_feature: GZ8MTXP02FJBEW.21.25.C03.1.454.CMB.2.raw
  modified_base (353)..(353): a, c, t, g, unknown or other
  modified_base (363)..(363): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagcgcctaccaaactcctcatctatggtaaccagcaatccggccctcgacggggtcccngaccgattcnctggctaccaagtctggcacctcacgccctccctggtaccagtccgcttcgggcctccgaggctggacgatgaggctgattattattgcctagtcctatcgaacacacctgcgttggtttgctcgtcggcgtcggacagtcg

SEQ ID NO: 401664 - DNA, 719 bp, Homo sapiens
  misc_feature: GZ8MTXP02I7JUX.21.25.C03.1.454.CMB.2.raw
  modified_base (273)..(273): a, c, t, g, unknown or other
  modified_base (283)..(283): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacgaggccatgctggagattgcctgagtgctgcctntgtcgcccanagctgaagcagacgcctaccaaactcctacatcctatcggtaaccagcaatccggccctcgacggggtcccctgacccgtatttccgtacgtcgggtccttacccgaaagttccgttcgggccctaacccgtttccgaacccggtcccccttcccccggttcggggttaccctaccgttcccggtccggttaccgggggtcccctttacccggaacgggtcccgttacgggacccgggtaagtcggtaaccgtaccgttaggttaaacttttagtttaacgtttccgacccgttaacggttaccccttaagttaccggaaaccctaaacccgtaccccgttcgggttaccggtttttcggggttttttccggtccgttttcggggtttcccgggggacccggggtacccggggtaaacccgtaaacggttccccgg

SEQ ID NO: 401665 - DNA, 680 bp, Homo sapiens
  misc_feature: GZ8MTXP02HDNSS.21.25.C03.1.454.CMB.2.raw
  modified_base (283)..(283): a, c, t, g, unknown or other
  modified_base (327)..(327): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgtagtgagcgaggagagtgaggaggagaggagaccaggccatgctggagattgcctgagtgctgcctctgtcgcccanagctgaagcaagacgcctaccaaaactcctcatctatggtaacncgacaatccgggccctcgacggggttcccctggaccgtattccgtctcgggctaccgaaagtccttcgggccctacctccgacgtccctcccgtcgggtctacgtccgcgttcgggaccttcccgaggctaggacgtagtacggacggtcgttaggtaatttaagtttacgttacggtccctaacgggttcccttaaagttaccggtaaaacctaaaccccgtaaacccccggtttagggttaccccggggttttaggggtttttttaccggggaaccgttttcgggggtttacccggggcccgggggtaccggggtaaaccccggtaaaacgggtccgtttaaccccggggg

SEQ ID NO: 401666 - DNA, 558 bp, Homo sapiens
  misc_feature: GZ8MTXP02G4APC.21.25.C03.1.454.CMB.2.raw
  modified_base (274)..(274): a, c, t, g, unknown or other
  modified_base (278)..(278): a, c, t, g, unknown or other
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgngcccanagctgaagcagacgcctaccaaactcctcatctatggtaaccagcaatcggccctgacggggtccctgaccgattctctggcctccaagtctggcacctcacgccctccctggtccagtccgcgtcggggcctccgaggtctagacgatgaggtctgtaatttagttacgttcgacctacggttcccttatacggaaccaaaccgtaccccgtggtccgtttggggttttcgcgtttcggttcggggccggtaccgggtaacccgaagtcccgg

SEQ ID NO: 401667 - DNA, 575 bp, Homo sapiens
  misc_feature: GZ8MTXP02G6W04.21.25.C03.1.454.CMB.2.raw
  modified_base (275)..(275): a, c, t, g, unknown or other
  modified_base (287)..(287): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgccttnttgtcgccccanagctagaagcgagacgccctaccaaaacctcctacatctaatacggaaccagcaacgtccggaccctcgacggggtccctagaccgtattcctcgtcggcctaccgtaagtcctcggccaacctcacgtccctccctggtcacgttcgcgtcgggcctccgacgtctgacgagtagagtctagtatttattacgttcgaccttacgtaccctatacgaaccaacctaccgtcgttccggtttggttttcgcgttcgggttccggccggggacgtaccgaacgtcccgg

SEQ ID NO: 401668 - DNA, 573 bp, Homo sapiens
  misc_feature: GZ8MTXP02H2QIN.21.25.C03.1.454.CMB.2.raw
  modified_base (276)..(276): a, c, t, g, unknown or other
  modified_base (281)..(281): a, c, t, g, unknown or other
  modified_base (286)..(286): a, c, t, g, unknown or other
  modified_base (313)..(313): a, c, t, g, unknown or other
  modified_base (319)..(319): a, c, t, g, unknown or other
  modified_base (365)..(365): a, c, t, g, unknown or other
  modified_base (379)..(379): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgcncccanagctgaagcagagcctaccaaactccnatctangtaacagcaatccggacctgacggggtccctagacctacttcgtcncggctaccaagtcncggccacctcgaccgtcccttacccgtgtcacgtcgcgtcgggcctccgacggtctcggacgatgaacggtcttagatttagtatcgtcctacgtaccttagtaccgaaccaaaccgttacccgtcggttccggtttggttttcgggccgttcgggttccggggccggtacccggggtaacgtaacggtcccgg

SEQ ID NO: 401669 - DNA, 551 bp, Homo sapiens
  misc_feature: GZ8MTXP02HHTQK.21.25.C03.1.454.CMB.2.raw
  modified_base (250)..(250): a, c, t, g, unknown or other
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgntggagatgtcctgagtgctgcctntgtcgcccanagctgaagcagacgcctaccaaactcctcatctatggtaaccagaccaagtccggccctcgacggggtccctgaccgtattcctcgtcgctaccgaagtctcggccacctcacgtcccttcccctggtccattccgcgtcggggccttccgaggtctggaccgtagtggaggtctagtatttattatcgacctagtcctatacgaccaaacctcccgtcgtcgtttggttttcgcgttcggttcggcggacggtacctaacggtccg

SEQ ID NO: 401670 - DNA, 531 bp, Homo sapiens
  misc_feature: GZ8MTXP02GO603.21.25.C03.1.454.CMB.2.raw
  modified_base (274)..(274): a, c, t, g, unknown or other
  modified_base (285)..(285): a, c, t, g, unknown or other
  modified_base (315)..(315): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctnttgtcgcccanagctagaagcagacgcctaccaaactcctnatctaatcggtaaaccagcaagtccggccctcgacggggtccctgaccgtattcctcgtggcctcaagtctgccacctcacgtccctcctggtcactcgcgtggctccgaggctgacgatgagctgatttatattgacctagtcctatacgtaaccaacgtaccgtcgtcgtttcggttttcgcgttcggttcggcggaccggtaacaacggtccg

SEQ ID NO: 401671 - DNA, 736 bp, Homo sapiens
  misc_feature: GZ8MTXP02G6XGJ.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctcgcccgtggggccccagaccaccggagggcggctgcgtcagcacgagacgtcgggcccaggaccctgtgcagtgagcgaggagagtggaggaggagaggacgaccgaggccagtgcgtggagtattcgtcctgaggtgctcgtcccttcgttgcccgaccctacgacgtccgtaggaaacgcgaacggaccgtacccctaaaccctaaaaccttccctactaaacttaccgtaaagttaacggtaaaccccacggtaacctaaacggtccccgggtaccccgtacggtacccggggttccctacggtaaacccggttctttcccgtccggtcgggtacccttaaccggtaacgttcccgtaccgggtaccctaacccgtccgtaaccccgtcccctttacccccggtcggttacccgtaccgtcccgggtccgtccggggtcccttaccggcggtacgtacgggacgtaacgtggacgtcgttagtaagtttattacgttcgaccgttacgtacctaagtacaaacctaaccgtccgtgttcggtttggtttcgcgttcggtcgggacggtaccggaacgtacgtcccgg

SEQ ID NO: 401672 - DNA, 555 bp, Homo sapiens
  misc_feature: GZ8MTXP02IE0KY.21.25.C03.1.454.CMB.2.raw
  modified_base (257)..(257): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctccccagcgcaggagatggtgaccgtctgccctggggccccagacaccgagggcggctgcgtcagcacagactgggcccaggaccctgtgcagtgagcgaggagagtgaggaggagaggagaccaggccatgctgganattgcctgagtgctgcctcttgtcgccccanagctgaagcagacgcctaccaaactcctcatctatggtaacagcaatccggccctcgacggggtcccctgaccgtattcctcgtggcctacctaagtccgcggccacctcgacgtccctcccgtggtcactccgcgtcgggcctccgaggtcgtcgacgagtgaggctgtatttattactcgcctacgtcctagtactaaccaacctacccgtgttccgtttgggttttcggtcgttcggttaccggcggtccgggactaacgtccg

SEQ ID NO: 401673 - DNA, 551 bp, Homo sapiens
  misc_feature: GZ8MTXP02F2ELA.21.25.C03.1.454.CMB.2.raw
  modified_base (215)..(215): a, c, t, g, unknown or other
  modified_base (275)..(275): a, c, t, g, unknown or other
  modified_base (286)..(286): a, c, t, g, unknown or other
  modified_base (365)..(365): a, c, t, g, unknown or other
  modified_base (370)..(370): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagngaggagagtgaggaggagaggagaccaggccatgctggagattgtcctgagtgctgcctnttgtcgcccanagctgaagcagacgccctaccaaactcctacatctatggtaaccagcaagtccgccctcgacggggtccctgaaccgtnttccncgtcggctaccaagtctcggccaccctcacgtcccctcccgtggtccacgtccgcgtcggggcctccgaggcctaggaccgagtggaggtctagtaatttattagttcgcctacgtcctatacgaaccaacctaccgtgtcgtttggtttcgcgttcggttcggcggtacggacacgtccg

SEQ ID NO: 401674 - DNA, 530 bp, Homo sapiens
  misc_feature: GZ8MTXP02IAKI3.21.25.C03.1.454.CMB.2.raw
  modified_base (386)..(386): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgccttttctgtcgcccacagctgaagcagacgcctaccaaactcctcaatctatggtaacccagaccaatccggccctcgacggggtcccctgaccgattcctctggctccaagtcnggcacctcacgccctccctgtcacgtcgctgggcctccgaggtctgacgagtcgaggctagtatttattattgcctagtcctatcgaaccaaactcccgtgtcgttggtttttcgcgttcggttcggcggtcgggaccagtccg

SEQ ID NO: 401675 - DNA, 546 bp, Homo sapiens
  misc_feature: GZ8MTXP02JJRPJ.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgcctgagtgctgccttctgcgcccangctgaagcagacgcctaccaaactcctcatctatggtaaccagcaactccggccctacgacggggtcccctgaccgtattcctcgtcggcctcctaaacgtcgtcggccacctcacgtccctcccgtcggtcacgtcgcgtcgggcctccgacggtcctgaccgagtcggaggtctagtatttattactgcctacgtcctatacgaactaactaccgtcgtcgttggtttcgcgttcggttcggcggtcggaccgacgtccg

SEQ ID NO: 401676 - DNA, 655 bp, Homo sapiens
  misc_feature: GZ8MTXP02H49JA.21.25.C03.1.454.CMB.2.raw
  modified_base (255)..(255): a, c, t, g, unknown or other
  modified_base (273)..(273): a, c, t, g, unknown or other
  modified_base (281)..(281): a, c, t, g, unknown or other
tcagtcgtcgctcgcacgaccggtgctcgatttagtagtgtagatttgggtttgggggctgttcctggaagttgctgataccagtgcacatcaaaaggtgaccccgatgttggagctgctcccagcgcaggagatggtgaccgtctgccctggggccccagacaccgagggcggctgcgtcagcacagactggcccaggaccctgtgcagtgagcgaggagagtgaggaggagaggagacaggccatgctggagnttgcctgagtgctgcctntgcgccangctgaagcagacgcctacaaactcctacatctataggtaaccagacaagtccggccctacggacggggtcccctaggacccgtatttcctcgtcgggacctacccgtaaacgtccgcggaccctacctccgacccgtccccttcccgtcgtacctacgtccgtcggtcggtccctccggacggtcgtacggacgtaggtacggacggtctaggttaatttacgttagttccgaaccgttacgtaaccgtttacgaaccgtaaacccgtaacccgttacccgttcgggtttccgggtttttacggggttttccggtcggtttccggggttacccgggggaccggggtacccgggtaaaccgtaccggtacccggg

SEQ ID NO: 401677 - DNA, 654 bp, Homo sapiens
  misc_feature: GZ8MTXP02JTWR7.21.25.C03.1.454.CMB.2.raw
  modified_base (302)..(302): a, c, t, g, unknown or other
  modified_base (477)..(477): a, c, t, g, unknown or other
  modified_base (481)..(481): a, c, t, g, unknown or other
  modified_base (499)..(499): a, c, t, g, unknown or other
  modified_base (509)..(509): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagaccaccggagggcgctgcgtcagcacagacgtcgggcccaggaccctgtgcagtgagcgaggagagtggaggaggagaggacgacgaggccagtgcgtaggagtattcgtctggagtgcgtgccttcgttgtccgccccanaggtcctaggaacgcgaacggacgacccctacccaaaaccttccctacaacttacctaagtacggtaaaccctacgactaaacgtcccgggcccctacgggaccggggttcccctaggacccgttacttcctcgtcggtcctaccgaacgtctcggccacctcacgtccctccgngtcncgtcgcgtcgggcctcgngctgacgagngacggtctagtattagttacgtcgacctacgttacctagtaccgtaaaccgtacccgtaccgttcggttacgggttttcgggttttcgggtccgtttcgggggttcccgggggaccggggtacccgggtaaccgtacggtcccgg

SEQ ID NO: 401678 - DNA, 562 bp, Homo sapiens
  misc_feature: GZ8MTXP02FKN87.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagcgccctaccaaactcctcatctataggtaaccagacaatccggccctcgacggggtccctgaccgtattcctcgtcggcctaccaagtcgtcggcctaccctccacgtccctcccgtcggtcacgtccgcgtcgggcctccgaggtctggacgagtggaggtctagtattattagttcgacctacgtcctatacgaaccaaccgtaccctgtccgtttggtttcggtcgttcgggttcgggcgggtaccgggaccgaacggtccg

SEQ ID NO: 401679 - DNA, 408 bp, Homo sapiens
  misc_feature: GZ8MTXP02F3TZ3.21.25.C03.1.454.CMB.2.raw
  modified_base (403)..(408): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcgcgggaccagctgaccgtctaggtcagcccaaggctgccccctcggtccactcctgttccccgccctccctcgcgcgacgactgagcgggctggacaaggcgcatagnnnnnn

SEQ ID NO: 401680 - DNA, 596 bp, Homo sapiens
  misc_feature: GZ8MTXP02HUB7X.21.25.C03.1.454.CMB.2.raw
  modified_base (321)..(321): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgccttcttgtcgccccacagctagaagcagacgccctaccaaaactcctanatctaagtacggtaaaccagtaccaaagtccgggcccttaccggacggggttcccctaggaacccgtatttccgtcgtcgggcctacccgtaaacgtctcggccaccctcacgtccctccctggtcacgtcgcgtcgggtcctcgaggtctgacgagtgagctagtattattatcgtacctacgttacctatacgaacctaaccgtacccgttgtccggtttggtttttcggtcgttcggtttccgggccgggtaccgggtaccgtaacggtccg

SEQ ID NO: 401681 - DNA, 584 bp, Homo sapiens
  misc_feature: GZ8MTXP02JP8YE.21.25.C03.1.454.CMB.2.raw
  modified_base (275)..(275): a, c, t, g, unknown or other
  modified_base (286)..(286): a, c, t, g, unknown or other
  modified_base (527)..(527): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccatgctggagattgcctgagtgctgcctnttgcgccccangctgaagcagacgcctaccaaactcctcatctatggtaaccagacaacgtccggccctacggaccggggtccctaggacccgtatttccgtcgtcgggccttacccgtaaagttccgtcggacccacccgtccgaccgtccccttccccgtcgggttaccctacgttccgcgttcggggccttaccgacggtctacgacggtatggacggtctgtaatttactagttcgcctacgtcctanacgacacgtacctcggtcgtttggtttcgcgttcggtcggcggtcggacgacgtacg

SEQ ID NO: 401682 - DNA, 503 bp, Homo sapiens
  misc_feature: GZ8MTXP02I34JK.21.25.C03.1.454.CMB.2.raw
  modified_base (274)..(274): a, c, t, g, unknown or other
  modified_base (283)..(283): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctntgtgcccanagctgaagcagacgcctaccaaactcctcatctatggtaaccagcaatcggccctcgacggggtccctgaccgtattctctggcctaccaagtctggcacctcacgcctccctggtcatcgctggctccgaggctgacgatgaggctgattatattcgctacgtcctatcgaacaacacccgtgtcgttggttttgcgtcggttcggcggcggacagtcg

SEQ ID NO: 401683 - DNA, 546 bp, Homo sapiens
  misc_feature: GZ8MTXP02F6RUL.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccacagctgaagcagacgcctaccaaactcctacatctatggtaaccagcaatccgcctcgacggggtccctgaccgtattctctggcctaccgaacgtctcggcctacctcacgtccctccctggtcatcgcgtcgggctccgaggtctgacgagtcgaggctagtatttagttattcgctacgtacctatacgtaacaacctacccgtcgtcgtttggttttcggcgttcggttcggcgggtaccggtaccgtaacggtccg

SEQ ID NO: 401684 - DNA, 578 bp, Homo sapiens
  misc_feature: GZ8MTXP02GM99O.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtcgcccanagctgaagcagacgccctaccaaactcctacatcctaatacggtaaaccagaccaacgtccggcccctcgacggggtcccctggacccgtattcctcgtggcctccaagtctcggccacctcacgtccctccctggtccagtccgcgtcgggcctccgacgggtctggaccgatcggaggctaggtatttacgttattcgcctacgttaccctaagtcgaaccaaacctacccgtgtccggtttggttttcggtcgttcggttccgggcgggaccgggtaccgtaacggtccg

SEQ ID NO: 401685 - DNA, 514 bp, Homo sapiens
  misc_feature: GZ8MTXP02F1JAQ.21.25.C03.1.454.CMB.2.raw
  modified_base (256)..(256): a, c, t, g, unknown or other
  modified_base (286)..(286): a, c, t, g, unknown or other
  modified_base (353)..(353): a, c, t, g, unknown or other
  modified_base (365)..(365): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtcctgagtgctgcctcttgcgcccanagctgaagcagacgcctacaaactcctcatctatggtaaccagcaatcggccctcgacggggtcccngaccgtattccnctggcctacaacgtctcggcacctcacgccctccctcggtcacgtcgcgtcggctccgacggctgacgagtgaggtctgtattattatgctacgtctatacgacaacacctcgtcgttggtttgtcgtcgttcggcggtcggacagtcg

SEQ ID NO: 401686 - DNA, 711 bp, Homo sapiens
  misc_feature: GZ8MTXP02G15ID.21.25.C03.1.454.CMB.2.raw
  modified_base (275)..(275): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtgccccanagctagaagcaagcgccctacccaaaactcctacatcctaagtaggtaaacccagaccaaagttcccgggcccctaccggaacgggggttccccctggaacccgtatttcccgtacgtcgggtaccctacccgtaaacgttccgttacgggaccctaaccccgttccgaacccgtcccccgttccccgttcgggttacctacgttccgtccggttcggggcccttcccggaacggtccgtagggaaccggtagttcgggaacggtcgttaggtaatttaatttagtttcggacccttaacggttacccctaagttacggaaaccctaaaccgttaaccccgttggttaccgggttttgggtttttcggccggttttacggggtttcccgggggccggggtaccggggaacccggtaacggtcccgg

SEQ ID NO: 401687 - DNA, 538 bp, Homo sapiens
  misc_feature: GZ8MTXP02G9I9B.21.25.C03.1.454.CMB.2.raw
  modified_base (330)..(330): a, c, t, g, unknown or other
  modified_base (465)..(465): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtcgcccacagctgaagcagacgcctaccaaactcctacatctatggtaaaccngacaagtccggccctcgacggggtcccctgaccgtatttcctcgtcggcctaccaaagtctacggccaccgtcacgccctcccgtggtccacgtcgcgtcgggcctccgaggtctgacgatggagtctagtattnttatgcctacgtcctatcgacaacctaccgtgtcgtttggtttgcgttcggttcggcggtcggaccgagtccg

SEQ ID NO: 401688 - DNA, 530 bp, Homo sapiens
  misc_feature: GZ8MTXP02HSC68.21.25.C03.1.454.CMB.2.raw
  modified_base (273)..(273): a, c, t, g, unknown or other
  modified_base (283)..(283): a, c, t, g, unknown or other
  modified_base (326)..(326): a, c, t, g, unknown or other
  modified_base (361)..(361): a, c, t, g, unknown or other
  modified_base (365)..(365): a, c, t, g, unknown or other
  modified_base (387)..(387): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctcctntgtcgcccangctgaagcagacgcctaccaaactcctacatctaatggtaacngacaactcggcccctgacggggttccctgaccgtnttcnctggctacagtctgcactcacnccctcctgtcactcgcgtggctccgagctgacgatgagctagtattattattcgacctagtcctagtacgacaaaccgtacctcgtcggtttcggttttggtcgttcggttcgggtccgggacggtaccgaacgtcgtaccgg

SEQ ID NO: 401689 - DNA, 559 bp, Homo sapiens
  misc_feature: GZ8MTXP02H8HKH.21.25.C03.1.454.CMB.2.raw
  modified_base (274)..(274): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagtgaggaggagaggagacaggccagtgctggagattgtcctgagtgctgcctnttgtcgcccanagctgaagcagacgcctaccaaactcctcatctatggtaaccagcaatccggccctagacggggtcccctggacctattctctggcctaccaagtcctggccaccctcacgtccctccctcggtccacgttccgcgtcgggcctccgaggctgacgagtgaggctagtatttattagtcgcctacgtcctatacgaaccaaacctaccctcggttcgtttgggtttttcggcgtttcgggttccgggtaccggaccggtaccgaacggtcccgg

SEQ ID NO: 401690 - DNA, 497 bp, Homo sapiens
  misc_feature: GZ8MTXP02HYC6D.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaaactcctcatctatggtaaccagcaatcggccctcgacggggtccctgaccgattcctctggctccaagtctggcacctcagccctccctggtcatcgctgggctccaggctgacgatgaggctgattattatgcagtcctatcgacaacacctgcgttggttttggcttgttcggcggtcggacaagtccg

SEQ ID NO: 401691 - DNA, 789 bp, Homo sapiens
  misc_feature: GZ8MTXP02H3LRM.21.25.C03.1.454.CMB.2.raw
  modified_base (248)..(248): a, c, t, g, unknown or other
  modified_base (257)..(257): a, c, t, g, unknown or other
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgcccgtggggccccagacaccgagggcggctgcgtcagcacagactcgggcccaggaccctgtgcagtgagcgaggagagtgaggaggagaggagacgaggcangctggagtnttgcctgagtgctgcctctgtcgcccangctagaacgcagacgaccctaccaaaccttcctacaacttcctaagtacggtaaccacgactaaacgtccggacccctcggaaccgggttcccctagtaaccgtactttccgtccgtcgggaccttacccgtaaacgttccgtacggtaccctacccgtaccgaacccgttcccccgttaccccggtcgggttacccgtaaccggttcccggtacccgggttccggggtaccccgttcccgggtaacgggttaccggttaacgggaacccgggtaaggttacgggtaacgggtaccgtttacggttaaatttttaacgtttaacgtttaccgtaacccgttacgttaacccgtttaacgtaaccgtaaaacccgtaaacccgttaaccccgttcgggtttaccgggttttacggggttttttaaccgggtccggtttaccgggggtttcccgggggtacccggggttaaccccggggtaaccggttaaaaccggttccccgggg

SEQ ID NO: 401692 - DNA, 514 bp, Homo sapiens
  misc_feature: GZ8MTXP02GTV85.21.25.C03.1.454.CMB.2.raw
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccanagctgaagcagacgccctccaaactcctcatctatggtaacccagcaagtcggccctcgacggggtccctgaccgtattctctggctccaagtctcggcacctcacgcctcctgtcatcgctgggctcgaggtctgacgatgacgtctgtattattattcgcctagttcctatcgaacaacctacccgtgtcgttggttttgcgttcggttcggcggtcggaccaggtcg

SEQ ID NO: 401693 - DNA, 623 bp, Homo sapiens
  misc_feature: GZ8MTXP02IOLHU.21.25.C03.1.454.CMB.2.raw
  modified_base (276)..(276): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtctgagtgctgcctntgtcgcccangctgaagcagacgcctacccaaactcctcatctagtggtaaccagacaacgtccggccctcggacgggtccctagaccgtattcctcgtggcctacaagtcgcggtcaccctcaccgtcccttcccgtggtcacgtcgcgtcgggcctccgacggtcgtacgacgtagtcggaggtcttagttaatttagtttaagttcgtacccgttacgttacccgttagtaccgtaaaccctaaacccgtaccccgttgggttccgggttttggggtttttccggtccggtttacggggtttaccgggggtccgggtaccggggtaacccggtaacggtcccgg

SEQ ID NO: 401694 - DNA, 519 bp, Homo sapiens
  misc_feature: GZ8MTXP02GHQ6I.21.25.C03.1.454.CMB.2.raw
  modified_base (284)..(284): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccangctagaagcagacgcctcccaaactcctcatctatagtaaccagcaatccggccctcgacggggtccctagaccgtattctctggcctccaagtctcggcacctcacgtccctccctggtccagtcgcgttcgggcctccgaggctgacgatcgaggctagtattattattgacctagtacctatcgacaacaccctgtcgtttggtttgcgttgtcggcgtacggaaccagtcg

SEQ ID NO: 401695 - DNA, 641 bp, Homo sapiens
  misc_feature: GZ8MTXP02G9J62.21.25.C03.1.454.CMB.2.raw
  modified_base (274)..(274): a, c, t, g, unknown or other
  modified_base (282)..(282): a, c, t, g, unknown or other
  modified_base (312)..(312): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggagagaggagacaggccatgctggaatagttgcctgagtgctgcctntgcgccangctgaagctagacgcctaccaaactcctanatctagtaggaaccagacaacgtccgtccctacggaacggggttcccaggtaaacccgtctttccgaccgttcggccttaaaccgtaacgtcctcggaccctaacccttacgcccgtcccgttcccgtccggtcgtacgtccgtcgtcggtccgtccgacggtcgtacgaccgtagtacggacgtcgtagtaagtttacgtttaattcgtaccgtacgttaccgttacttaacgaacctaaaccgtacccgttacgttcggtttcgggttttcggttcgtttcgggttccgggttccgggtaccggggaacccggtaacggtaacccgg

SEQ ID NO: 401696 - DNA, 553 bp, Homo sapiens
  misc_feature: GZ8MTXP02IDFRB.21.25.C03.1.454.CMB.2.raw
  modified_base (256)..(256): a, c, t, g, unknown or other
  modified_base (284)..(284): a, c, t, g, unknown or other
  modified_base (314)..(314): a, c, t, g, unknown or other
  modified_base (383)..(383): a, c, t, g, unknown or other
  modified_base (389)..(389): a, c, t, g, unknown or other
  modified_base (443)..(443): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagntgcctgagtgctgcctcttgtcgcccanagctagaagcagacgcctaccaaactcctnatctatggtaaccagcaatccggcctcgacggggtccctgaccgtacttctctggccttccaacgttcnggaccncctcacgtcctccctcggtctacgtcgtcgtcggcgtccgacggcgtgacgagngagtacgtagtattattagtcgtctacgtactactactaactaactactcgttcgttcggtttcggttttcggttcggttcggttcgggtccgggtacgggtacggtacg

SEQ ID NO: 401697 - DNA, 510 bp, Homo sapiens
  misc_feature: GZ8MTXP02JT2D6.21.25.C03.1.454.CMB.2.raw
  modified_base (275)..(275): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccacagctgaagcagagcctaccaaactcctcatctatggtaaccagcaatccggccctcgacggggtccctgaccgtattctctggctccaagtctcggccacctcacgccctcccgtggtccagtccgcgtgggcctccgacggctgaccgatgaggctgtattattattgctacgtcctatcgacaacaccctgtcgttggtttgcttcgtcggcgcggacagtcg

SEQ ID NO: 401698 - DNA, 572 bp, Homo sapiens
  misc_feature: GZ8MTXP02GPLUK.21.25.C03.1.454.CMB.2.raw
  modified_base (289)..(289): a, c, t, g, unknown or other
  modified_base (318)..(318): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccgaggccatgctggagtattgtcctgagtgctgcctcttgtcgccccanagctgaagcagacgcctaccaaactcctnatctatggtaaccagcaatccggccctcgacggggtccctagacccgattccgtctggccttacccaaagttcctggccctaaccctcgacgtccccttcccgttggtccagtccgtcgtggggcctcccgaggcttcggacgtatggacggtctagtaatttattatttgaccctagttcctatcgtaaaccaactccctggtccgtttggttttcggcgttcggttcgggccggtcgggaacctacggtccg

SEQ ID NO: 401699 - DNA, 523 bp, Homo sapiens
  misc_feature: GZ8MTXP02FEKCT.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccccangctgaagcagagccctaccaaactcctcatctatggtaaccagcaaatccggcccctcgacggggtccctgaccgtatttctctggctccaaagtctggccaacctcacgtccctccctggtccatccgcgtggggcctccgaggctggaaccgagtgacggctagtattattattgcctagtcctatcgaacaacacccttgcgtttggtttgcttggtcggcggacggacagtcg

SEQ ID NO: 401700 - DNA, 551 bp, Homo sapiens
  misc_feature: GZ8MTXP02HQ8ZN.21.25.C03.1.454.CMB.2.raw
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctccaaactcctacatctatggtaaccagcaagtccggcctacgacggggtccctagaccgtattcctcgtcggctaccgaagtctcggccacctcacgccctcccgtgtccatccgcgtcgggtcctccgacggtctacgacgagtggaggtctagtatttattatttgcctacgtaccttagcgaacaacctacccgtcgtccgtttggttttggcgttcggttacgggcggtaccggactacggtcg

SEQ ID NO: 401701 - DNA, 401 bp, Homo sapiens
  misc_feature: GZ8MTXP02IEFP6.21.25.C03.1.454.CMB.2.raw
  modified_base (396)..(401): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttgctgttcggcgcgggaccagctgccgtcagtcagcccaaggctcgcccctggtccactctcgtcccgccctccgtcgacgcgacgacgtgacgcgggctggcaagcgcatagnnnnnn

SEQ ID NO: 401702 - DNA, 611 bp, Homo sapiens
  misc_feature: GZ8MTXP02HVYE2.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacgaggccagtgcgtggagtattgcctgagtgctgccttcttgtcgccccanagctagaagcagacgccctaccaaactccacatctatagtaaccagacaacgtccggccctcggacggggtcccctagacctacttccgtcgtcgcctaccaagttcgcggcctacccgtcaccgtccctcccgtggtacctacgtccgcgtcggggtccctccggaggtctacggacgtagtaggacgtcttaggtactttagttagttcgacctacgtccttacgacgaacctaaaccgtccccgttggttaccggttttcgggttttcggtcgtttcggggttaccgggcggggtacccgggaacgtaacggtcccgg

SEQ ID NO: 401703 - DNA, 748 bp, Homo sapiens
  misc_feature: GZ8MTXP02GV4CD.21.25.C03.1.454.CMB.2.raw
  modified_base (274)..(274): a, c, t, g, unknown or other
  modified_base (298)..(298): a, c, t, g, unknown or other
  modified_base (313)..(313): a, c, t, g, unknown or other
  modified_base (329)..(329): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacgagacgtcgggcccaggaccctgtgcagtgagcgaggagagtggaggaggagaggacgaccgaggccagtgcgtggagtattcgtcgngagtgctgccttgttcgcgcccangctagaacgcagacncctaccaaactcctanatacgtaagtacggtaaaccagtacaacgtccggcctacggtacgggtccctgaccgtactttccgtacgtcgtacctacgtaacgttccgtacggtaccctacccgtccgacccgttcccccgttacccggttcggtacccttaccggtccggtacccggttacgggtccccgtacccggtaacggggtccgttaacgggaaccgggtagtacgggtaaaccgggtttacttaagtttaacgtttacgttaccgttaccgtaaccgttaacgttacccgttaaacgtaaacccgtaaacccgttaaacccggtttccggtttacgggttttccggggtttttacggggttccggttaccgggttaccgggggtacccgggtaacccggggtaaccggtaaaccggtaccggtacccgg

SEQ ID NO: 401704 - DNA, 575 bp, Homo sapiens
  misc_feature: GZ8MTXP02GUIQC.21.25.C03.1.454.CMB.2.raw
  modified_base (289)..(289): a, c, t, g, unknown or other
  modified_base (321)..(321): a, c, t, g, unknown or other
  modified_base (527)..(527): a, c, t, g, unknown or other
  modified_base (547)..(547): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgcccgtggggccccagacaccgagggcggctgcgtcagcacagactgggcccaggaccctgtgcagtgagcgaggagagtgaggaggagaggagaccaggccagtgcgtggagtattcgtctgagtgctgccttgttgcgcccanagctagaagcagacgccctaccaaactcctanatctagtggtaaccagctaagtccggcctacggacggggtccctagaccgtattcctcgtcggcctaccgaacgttcgtcggcctacctcgaccgtcccttcccgtggtcctacgtccgtcgtcggggcctacccgaggtctacggaacgtagtcggacggtctagtaatttagttacgtcggtccgttactagtcgaacctaacnccgttgtcgtttggtttcgngttcggtcggcggcggactacgcgtacg

SEQ ID NO: 401705 - DNA, 506 bp, Homo sapiens
  misc_feature: GZ8MTXP02IEG84.21.25.C03.1.454.CMB.2.raw
  modified_base (284)..(284): a, c, t, g, unknown or other
  modified_base (299)..(299): a, c, t, g, unknown or other
  modified_base (312)..(312): a, c, t, g, unknown or other
  modified_base (324)..(324): a, c, t, g, unknown or other
  modified_base (329)..(329): a, c, t, g, unknown or other
  modified_base (348)..(348): a, c, t, g, unknown or other
  modified_base (353)..(353): a, c, t, g, unknown or other
  modified_base (357)..(357): a, c, t, g, unknown or other
  modified_base (369)..(369): a, c, t, g, unknown or other
  modified_base (375)..(375): a, c, t, g, unknown or other
  modified_base (385)..(385): a, c, t, g, unknown or other
  modified_base (391)..(391): a, c, t, g, unknown or other
  modified_base (406)..(406): a, c, t, g, unknown or other
  modified_base (452)..(452): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccgaggccagtgctggatattgcctgagtgctgcctgttgcgcccanagctagaagcagacnccctacaaactcncatcatgaaccngacanccggcctcgacgggtcccngactnttcncgtgctcattcngccacncacgcctcgngtaccncgtcgcgtcgctcgngtcagacgagtgagtctagttatttagttcgtcgactacgtactanactaccaacctcgtgttcgtttggttcgcgttcggtcggcggtacgacacgtcg

SEQ ID NO: 401706 - DNA, 573 bp, Homo sapiens
  misc_feature: GZ8MTXP02I3L4B.21.25.C03.1.454.CMB.2.raw
  modified_base (275)..(275): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtcgcccanagctgaagcagacgccctaccaaactcctacatcctatcggtaaccagcaagtccggccctcgacggggtccctgacccgtattcctctggcctccgaagtctcggcctacctcacgtccctcccgtcggtcacgtcgcgtcgggcctccgacggtctcgacgtagtcgaggtctagtaattattagttcgtacctacgtcctagtacgaacctaaacctaccgtcggtccgtttgggttttcggtcgttcggttccgggccgggtaccgggtaaccgtaacggtccg

SEQ ID NO: 401707 - DNA, 529 bp, Homo sapiens
  misc_feature: GZ8MTXP02GJ8D8.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccacagctgaagcagagcctccaaactcctcatctatggtaaccagcaatccggccctcgacggggtccctgaccgtattcctcgtggcctccaagtctggccacctcacgtcctccctggtcatcgcgtgggcctccgaggtctagacgtagtgaggctagtatttattagttcgctacgtcctatcgaacacctaccctgtccgtttggtttcgggtcgttcggcggacggacgacgtcgtacgg

SEQ ID NO: 401708 - DNA, 533 bp, Homo sapiens
  misc_feature: GZ8MTXP02JFKEG.21.25.C03.1.454.CMB.2.raw
  modified_base (273)..(273): a, c, t, g, unknown or other
  modified_base (283)..(283): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgctgagtgctgcctntgtcgcccanagctgaagcagcgcctacccaaactcctacatctagtcggtaaccagcaatccggaccctcgacggggtccctgaccgtattcctctggcctcaagtctggccacctcacgtccctccctggtcacgtcgcgtcgggccttccgacggtctaggacgagtgacggtctggtatttagttatcgacctacgtcctatcgaacacctacctacgtccgttgtttcggcttcggttcggcggcggaccagtcg

SEQ ID NO: 401709 - DNA, 519 bp, Homo sapiens
  misc_feature: GZ8MTXP02FNCRG.21.25.C03.1.454.CMB.2.raw
  modified_base (255)..(255): a, c, t, g, unknown or other
  modified_base (263)..(263): a, c, t, g, unknown or other
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtccngagtgctgcctnttgtcgcccanagctggaagcagacgcctccaaactcctcatctatggtaaccagcaaatccggccctcgacggggtccctgaccgtattcctctggcctaccaagtctggcacctcacgcctccctgtcatcgctgggctcagctgacgatcgagtctgtattattatgccacgttcctatcgacctaacaccctgtcgtttggttttgcgttcggttcggggcggtccgggaccaaggtccg

SEQ ID NO: 401710 - DNA, 571 bp, Homo sapiens
  misc_feature: GZ8MTXP02JRTHG.21.25.C03.1.454.CMB.2.raw
  modified_base (286)..(286): a, c, t, g, unknown or other
  modified_base (316)..(316): a, c, t, g, unknown or other
  modified_base (332)..(332): a, c, t, g, unknown or other
  modified_base (372)..(372): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgccttctgtcgcccanagctagaagcagacgcctaccaaactcctnatctagtggtaaaccngacaacgtccggcctcgacggggtcccagaccgtattccncgttcggcctaccgaagtctcggccacctcgacgtcctcctggtccagtccgcgtcgggcctcgacggtctagacgagtcgacggcttagtatttagttaacgtcgaccgtacgtaccctatacgaaacctaacctaccgttcggtcgtttggttttcggtcgttcgggttccgggcgggtaccggaacgtacgtccgg

SEQ ID NO: 401711 - DNA, 581 bp, Homo sapiens
  misc_feature: GZ8MTXP02HB45T.21.25.C03.1.454.CMB.2.raw
  modified_base (253)..(253): a, c, t, g, unknown or other
  modified_base (271)..(271): a, c, t, g, unknown or other
  modified_base (281)..(281): a, c, t, g, unknown or other
  modified_base (367)..(367): a, c, t, g, unknown or other
  modified_base (385)..(385): a, c, t, g, unknown or other
  modified_base (396)..(396): a, c, t, g, unknown or other
  modified_base (499)..(499): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggcatgctgganattgctgagtgctgcctnttgcgcccanagctagaacgcagacgcctaccaaactcctcatctatcggtaacagcaacgtccggccctcggacggggtccctgaccgtacttcncgtggcctacgaacgtcncggccacctcncgtccctcccgtggtcacgtccgcgtcgggctacccgaggtctggaacgtcgtggacggtctagttactttaaatttcgttcggacccttaggttacccttanacgaaacctaaccgtacccgtggttccgttttgggtttcggtacgttcgggttcggggccggtacggggacctaaggtcccg

SEQ ID NO: 401712 - DNA, 594 bp, Homo sapiens
  misc_feature: GZ8MTXP02I8A1J.21.25.C03.1.454.CMB.2.raw
  modified_base (328)..(328): a, c, t, g, unknown or other
  modified_base (340)..(340): a, c, t, g, unknown or other
  modified_base (352)..(352): a, c, t, g, unknown or other
  modified_base (379)..(379): a, c, t, g, unknown or other
  modified_base (387)..(387): a, c, t, g, unknown or other
  modified_base (394)..(394): a, c, t, g, unknown or other
  modified_base (406)..(406): a, c, t, g, unknown or other
tcagtcgtcgctcgcacgaccggtgctcgatttagtagtgtagatttgggtttggggcgtgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtgccccacagctgaagcagacgcctcccaaactcctcatctatggaaccancaatcggccctnaggggtcccgtnaccgtattcctctgggctaccaactcngtccaccnccgtacnccctcctcgttnactcgcttcgggctccgacggtcgtcgtacggagtgaaggtcgtacgttagtttatttacgttgtaccgtccggtaccttagttaacgaccgtaaaacctacccgtccggttacggtttcgggttttaacggggtttcgttaccgggtttccgggttaccggaccgggggttaacccgaacggtaccg

SEQ ID NO: 401713 - DNA, 516 bp, Homo sapiens
  misc_feature: GZ8MTXP02IDGNS.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtgccccacagctgaaagcagagccctccaaactcctcatctatggtaaccagccaatccggccctcgacggggtccctgaccgattctctggctccaagtctggcacctcacgcctcctggtcactcgcgtcgggcctccgacggtctcggacgagtgaggtctgtatttattattcgcctagtcctatcgacaacaccctgtcgttggtttgctcggttcggcggcggtacacgtcg

SEQ ID NO: 401714 - DNA, 671 bp, Homo sapiens
  misc_feature: GZ8MTXP02H006P.21.25.C03.1.454.CMB.2.raw
  modified_base (513)..(513): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtgggcccaggaccctgtgcagtgagcggaggagagtggaggaggagaggagaccgaggccagtgcgtggagtatgtccgtggagtgctcgtccttcgttgccgcccagagctagaacgcagacgtcccctaacaaacctccctataacttaccgtaagtacggtaaaccacgtaacctaaccggtcccggtaccccgttaccgggaacccgggggttcccccttaggggtaaacccgttaccttttccgtcccgtcgggtacccttacccgtaacgttccgtcggaccctacccgtccgacccgtcccgttcccgtcggtcncgttccgcgtcggcctcgacggtctagacgagtaggacggtcttagtatttagttacgttcgacctacgtaccttagtaccgaacctaaccgtaccgtcgttcggtttcggttttcggcgtttcgggttccgggccggacccggtacgtacggtcccg

SEQ ID NO: 401715 - DNA, 667 bp, Homo sapiens
  misc_feature: GZ8MTXP02FRIXY.21.25.C03.1.454.CMB.2.raw
  modified_base (219)..(219): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggngagtgaggaggagaggagaccaggccatgctggagattgtcctgagtgctgcctcttgtcgcccacagctgaagcagacgcctaccaaactcctcatctatggtaaccagcaatccggccctcgacggggtccctgacccgtattcctctacgggcctaccgtaaacgtcgtcggccctaacccttcgaccgtcccctccccgttcggtcctacgtccggtcgtcggggtcccttcccgaacggtccgttacggaaccggtagttacggaacggggtccttaggttaagtttactttaagttccggtaccctaacggttcccttaaacgtacggtaaaaccctaaacctaaccccgttcggttacccggttttggggtttttcgggtaccggtttacggggtttcccggggccggggtacccgggggaacccgtaacggttaccccgg

SEQ ID NO: 401716 - DNA, 597 bp, Homo sapiens
  misc_feature: GZ8MTXP02GG09T.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccacagctgaagcagacgcctaccaaactcctacatctatggtaaccagcaatccggccctcgacggggtccctgacccgtattccgtcgtcggctacccgtaagtccgtacggccacctcacgtccctcccgtggtccacgtcgccgtcggggcctccgacggtcctggaccgtatacggacggtcttagtatttagttaacttcgtacctacgttaccctagtacgaaaccaaacctacccgttgtccggtttgggttttcggtcggtttcggtttccggggaccgggtaccgggaaccgtaacggtcccgg

SEQ ID NO: 401717 - DNA, 535 bp, Homo sapiens
  misc_feature: GZ8MTXP02JJ2KK.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgccccanagctgaagcaagacgccctaccaaaactcctacatctatcggtaaaccagacaaatccggccctcgacggggttcccctgaacccgtattcctcgtcggctcccaaacgtctggccacctcacgccctccctggtcatcgctcgggcctccgaggctgacgatgagctgtattattatgcctacgtcctatcgaacaaccacctcgtcgttggtttcggcgttcggttcggcggcggtaccaagtccg

SEQ ID NO: 401718 - DNA, 545 bp, Homo sapiens
  misc_feature: GZ8MTXP02IKF3K.21.25.C03.1.454.CMB.2.raw
  modified_base (283)..(283): a, c, t, g, unknown or other
  modified_base (311)..(311): a, c, t, g, unknown or other
  modified_base (483)..(483): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgcctgagtgctgcctcttgtgccccanagctagaagcagagcctacaaactcctnatctatggtaaccagacaatccggccctacgacggggtccctgacccgtatttcctcgtggcctaccgaagttcgtcggctacctcacgtccctcccgtggtccacgtccgcgtcggggcctccgaggtctagacgatgaggctagtatttattagtcgacctagtacctanacgtaacaacctacccgtgtcgttggttttcgcttcggttcggacggtcggacgtaagtccg

SEQ ID NO: 401719 - DNA, 405 bp, Homo sapiens
  misc_feature: GZ8MTXP02HX3NM.21.25.C03.1.454.CMB.2.raw
  modified_base (356)..(356): a, c, t, g, unknown or other
  modified_base (367)..(367): a, c, t, g, unknown or other
  modified_base (395)..(395): a, c, t, g, unknown or other
  modified_base (401)..(405): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctcctggtcatcgctgggctccaggctgacgatgaggctgattattatgccagtcctatgacaacaccctgcgtggttttgctgttcggcggcgggaccagctgaccgtctaggtcagcccaaggctcgcccctcggtccactctcgttccccnccctcctccgngcgacgactgagcgggctcggcaaggcncatagnnnnn

SEQ ID NO: 401720 - DNA, 562 bp, Homo sapiens
  misc_feature: GZ8MTXP02FX9Y1.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccatgctggagattgtcctgagtgctgcctcttgtcgcccanagctagagcagacgcctaccaaactcctacatctatggtaaaccagacaacgtccggccctacgacggggtcccctgacccgtattcctcgtggcctaccgtaagtctcggccacctcgaccgtccctcccgtggtccacgtccgcgtcgggcctccgtaggctgacgagtgacgtctagtattattatcgacctacgtcctatacgtaaccaaactcccgttagtccggtttggttttcggtcgtcggttcgggccggtcgggaaccaacggtccg

SEQ ID NO: 401721 - DNA, 598 bp, Homo sapiens
  misc_feature: GZ8MTXP02G9L4E.21.25.C03.1.454.CMB.2.raw
  modified_base (275)..(275): a, c, t, g, unknown or other
  modified_base (286)..(286): a, c, t, g, unknown or other
  modified_base (314)..(314): a, c, t, g, unknown or other
  modified_base (327)..(327): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccanagctgaagcagacgcctaccaaactccncatctatgaaccngcaatccgcctagacggggtccctagaccgtattcgcgtcgcctaccaagtctcggccaccgtcacgccctccgtggtcacgtccgcgtcgggccttccgacggtctagaccgagtcggaggtcttagtaatttagttacgttcggacccttaacggtacccttaagtaccgtaaacccaacccgttacccgttaggttccgggttttagggtttttcggtcggtttcgggttccggggtaccgggtaccgggtaaccgaacggttcccgg

SEQ ID NO: 401722 - DNA, 531 bp, Homo sapiens
  misc_feature: GZ8MTXP02HDJZO.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggaggagaggagaccaggccatgctggagattgcctgagtgctgcctcttgtcgcccacagctgaagcagacgcctcccaaaactcctacatctatggtaaccagcaatccggccctcgacgggtccctgaccgtattctctggctcaagtctggcacctcacgccctccctggtcagtcgcgtgggcctccgaggtctagacgatgaggtctagatttattatcgcctacgtacctatacgaaccaactacccgtcgtcgtttcggttttggcgttcggttcggcgggcggtaccgaacggtccg

SEQ ID NO: 401723 - DNA, 512 bp, Homo sapiens
  misc_feature: GZ8MTXP02F9487.21.25.C03.1.454.CMB.2.raw
  modified_base (286)..(286): a, c, t, g, unknown or other
  modified_base (353)..(353): a, c, t, g, unknown or other
  modified_base (358)..(358): a, c, t, g, unknown or other
  modified_base (363)..(363): a, c, t, g, unknown or other
tcagtcgtcgctcgcacgaccggtgctcgatttagtagtgtagatttgggtttgggggttgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctaccaaaactcctcatctatggtaacagcaatccggcctcgaggggtcccngaccnttccntgctccaagtctggcacctcacgccctcccgtggtcactcgcgtcgggcctccgaggctgacgatgagctagatttatattcgctagtcctatcgaccaacacctgtcgttggttttcgcgttggtcggcggtcggacacgtcgtacgg

SEQ ID NO: 401724 - DNA, 503 bp, Homo sapiens
  misc_feature: GZ8MTXP02HXELK.21.25.C03.1.454.CMB.2.raw
  modified_base (326)..(326): a, c, t, g, unknown or other
  modified_base (362)..(362): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtgcccacagctgaagcagacgcctaccaaactcctcatctatggtaaccngcaatcggccctcgaggggtccctgaccgattctcnggctccaagtctggccacctcacgccctccctggtcactcgcgtcgggctcaggctgacgatgaggctgattattatgcctagtcctatcgacaacaccctgtcgttggttttgctggttcggcggtacgggacaacgtcg

SEQ ID NO: 401725 - DNA, 545 bp, Homo sapiens
  misc_feature: GZ8MTXP02HLRSD.21.25.C03.1.454.CMB.2.raw
  modified_base (274)..(274): a, c, t, g, unknown or other
  modified_base (284)..(284): a, c, t, g, unknown or other
  modified_base (324)..(324): a, c, t, g, unknown or other
  modified_base (377)..(377): a, c, t, g, unknown or other
  modified_base (384)..(384): a, c, t, g, unknown or other
  modified_base (498)..(498): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgtcctgagtgctgcctnttgcgcccangcagaagcagacgcctaccaaactctcatctatggaaccngacaagtccgacctcgacggggtccctgaccgtattcctcgtgcctcaagtcnggcaccncacgtccctccgtggtcacgtccgtcgtcgggccttaccgaaggtatcggaacggtatcggaagtcgtagtatttattagtcgacctacgtccttagacacgtaaacctcccgngttccgtttggtttcgcttcggttcggacggtccggacctaagtccg

SEQ ID NO: 401726 - DNA, 538 bp, Homo sapiens
  misc_feature: GZ8MTXP02IQJ78.21.25.C03.1.454.CMB.2.raw
  modified_base (277)..(277): a, c, t, g, unknown or other
  modified_base (422)..(422): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagaccaccgagggcggctgcgtcagcacagactgggcccaggaccctgtgcagtgagcgaggagagtgaggaggagaggagaccaggccagtgctggagattgtcctgagtgctgcctntgtcgcccacagctgaagcagacgccctaccaaactcctcatctagtggaaccagcaatccggccctgacggggtcctgaccgtattctcgtggcctccaagtctcggcacctcacgcctcccgtgtcatcgcgtgggcctccgnggtctcgacgtagtcgagtctagtatttattagtgaccgtaactcctatacgaaccaacctacccgtgtcgtttggttttcggcgttcggttcggcggtacggacctaacggtccg

SEQ ID NO: 401727 - DNA, 577 bp, Homo sapiens
  misc_feature: GZ8MTXP02JJ7WF.21.25.C03.1.454.CMB.2.raw
  modified_base (290)..(290): a, c, t, g, unknown or other
  modified_base (388)..(388): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcgctgcgtcagcacagactgggcccaggaccctgtgcagtgagcgaggagagtgaggaggagaggagaccaggccagtgctggagattgtcctggagtgctgccttcttgtcgccccanagctgaacgcagacgccctaccaaactcctacagtcctaagtcggtaaaccagaccaacgtcccgggccctcggacggggtcccctgaccgtattccncgtcggcctaccaagtctcggccacctcacgccctcccgtggtcactcgcgtgggcctacgaggtccgtgaacgtgtgaggtcttagtatttattagttcgccctagttccctaagtcgaaacctaaactcccgtggttcggtttggttttggtacggttcggacgggtaccggactacgtcgtaccgg

SEQ ID NO: 401728 - DNA, 543 bp, Homo sapiens
  misc_feature: GZ8MTXP02IZTMS.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtcgcccanagctagaagcaagacgcctaccaaactcctacattctaagtacggtaaacccagacaaacgtccggaccctcggacggggtcccctagacccgtattcctcgtcggcctaccaagtctggccacctcacgccctccgtcggtcactcgcgtcgggcctccgaggtctagacgatgagctgtatttattattgcctactcctatcgaacaactaccgtcgtcgttggtttgcgtcggttcggcggtccggacgacgtcg

SEQ ID NO: 401729 - DNA, 551 bp, Homo sapiens
  misc_feature: GZ8MTXP02IZIZO.21.25.C03.1.454.CMB.2.raw
  modified_base (274)..(274): a, c, t, g, unknown or other
  modified_base (285)..(285): a, c, t, g, unknown or other
  modified_base (331)..(331): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctnttgtcgcccanagctagaagcagacgccctaccaaactcctcatctatggtaaaccngacaagtccggccctcgacggggtccctggaacccgtattcctctcggcctaccaagtcctggccacctcacgccctcccgtgtcatccgcgtggctccgaggctagacgatgagctgattattatcgacctacgtactagtacgaaacctaacctacccgtcgtcggtttcggttttggtccgttcggttccgggcgggtaccgggacctaacggtccg

SEQ ID NO: 401730 - DNA, 550 bp, Homo sapiens
  misc_feature: GZ8MTXP02GTK6I.21.25.C03.1.454.CMB.2.raw
  modified_base (276)..(276): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgccttnttgcgcccanagctgaagcagacgcctaccaaactcctacatctagtacggtaaaccagaccaatccggcccctcgacggggtcccctgaccgtattcctcgtggcctcaagtctggcacctcacgtccctcccgtggtacagtcgcgtcgggacctccgacggtcgtagacgtagtcggagtctgtaatttattattcgcctacgtctatacgaacaacctaccgtcgtcgtttggttttcggcgttcggttcggcggtaccggacacgtccg

SEQ ID NO: 401731 - DNA, 556 bp, Homo sapiens
  misc_feature: GZ8MTXP02JVQ6Y.21.25.C03.1.454.CMB.2.raw
  modified_base (284)..(284): a, c, t, g, unknown or other
  modified_base (292)..(292): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggcatgctggagattgtcctgagtgctgcctcttgtcgcccangctagaancagagccctaccaaactccacatctatggtaaaccagacaatccggcctcgacggggtccctgaccgtattctcgtcggcctcaacgtcgtcggcctacctcacgtccctcccgtggtccacgtcgcgtcgggcctccgaggctgacgtagtggacggtctagtatttagttattcgacctacggtaccctagtcgaaacaacctacccgtcggtccgtttggtttcggcgtttcggtcgggtacggccgggtaacacggtccg

SEQ ID NO: 401732 - DNA, 694 bp, Homo sapiens
  misc_feature: GZ8MTXP02H8UR3.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagtgaggaggagaggagacaggccatgctggagattgcctgagtgctgcctctgtcgccacagctagaagcagacgccctaccaaactcctacattctagtcggtaaaccagacaacgtccggacccttcggaccggggttcccctaggtacccgtactttcccgtcgtcggccttacccgaacgttccgtacggccctaaccccgttccgacccgttcccccttccccgttcgggtaccctaccgttccggtccgtcggggtcccttacccggacgggtcgttacgggaaccggtagtacgggaacggtcttaggtaacttttaattacgtttacgacccgttaacgttacccttagtaaccgaaaccctaaacccgttacccccgttaggttacccggtttttggggtttttccgggtccgtttcggggttcccggggtaccggggacccgggtaacccgtaacggtcccgg

SEQ ID NO: 401733 - DNA, 488 bp, Homo sapiens
  misc_feature: GZ8MTXP02FGY12.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagacgcctccaaactcctcatctaatggtaaccagcaaatcggccctcgaggggtccctgaccgattctctggctccaagtctggcacctcagccctccctggtcatcgctgggctccaggctgacgatgaggctgattatattgccagtcctatcgacaacacctgcgttggtttgctgtcggcgcggacagcg

SEQ ID NO: 401734 - DNA, 609 bp, Homo sapiens
  misc_feature: GZ8MTXP02GNIK7.21.25.C03.1.454.CMB.2.raw
  modified_base (263)..(263): a, c, t, g, unknown or other
  modified_base (275)..(275): a, c, t, g, unknown or other
  modified_base (284)..(284): a, c, t, g, unknown or other
  modified_base (313)..(313): a, c, t, g, unknown or other
  modified_base (369)..(369): a, c, t, g, unknown or other
  modified_base (429)..(429): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtccngagtgctgcctntgtgcccangctagaagcagcgcctaccaaactcctanatctatcggtaacagcaagtcggccctcgacggggttcccaggaccctagtttccncgtcggtcctaccgtaaacgtcgttcggcctacctccacgtccctcccgtcggtcctacnccgtcgtcgggtcctccgacggtctcggacgagtacggaggtctagtatttagttaacgttcgactacgttacctaatacgaaacctaaaccgtacccgttacgtccgggtttggttttcgggttcgtttcgggtttaccggggtccggggtaccggggaacccgtaaacgggttcccgg

SEQ ID NO: 401735 - DNA, 774 bp, Homo sapiens
  misc_feature: GZ8MTXP02HITGF.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcggaggagagtggaggaggagaggacgaccgaggccagtgcgtggaagtagttgtcctaggaggtgccgtggtccttcgttgtccgcccctacgaggcctaggaacgccgaaggaccgccccttacccaaaaccttccctacaactttcgtaacgttacgggtaaaacccacgactaaacgtcccggggtacccctcggggacggggttccccctagggtaaacccgtctttccgtcgtcgggacccttacccgtaaacgttccgtacggtcccaacccgttccaaccgtcccccgttccccgttcgggtccctaacggttccggtccggttcggggtcccgttacccggacgggttccgttacggacccggtaggttcggaacgggtcgttaaggttaatttaacgtttaagttcgacccgttaacgttacccttaggtactaaaacccgtaaccgtaccccgtttgggtttccggttttcgggggtttttccggtcggttttccggggttaccggggtcccgggggtaccggggtaacccgtaacgggttccccggg

SEQ ID NO: 401736 - DNA, 554 bp, Homo sapiens
  misc_feature: GZ8MTXP02GSYWL.21.25.C03.1.454.CMB.2.raw
  modified_base (275)..(275): a, c, t, g, unknown or other
  modified_base (285)..(285): a, c, t, g, unknown or other
  modified_base (294)..(294): a, c, t, g, unknown or other
  modified_base (328)..(328): a, c, t, g, unknown or other
  modified_base (416)..(416): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgcgcccanagctagaancagacgcctaccaaactcctcatctatggaaccngacaatccggcctacgacggggtccctagacccgtattcctcgtcgcctacgaagtctacggaccacctcacgtccctccctggtacncgtccgtcgtcgggcctccgaggtctgacgtagtcggaggtctagtaacttattagtcgacctacgttcctaagtcgaaacctacaccctgttacggtttcggtttgcgttcggttcggcggtacggaccaaggtccg

SEQ ID NO: 401737 - DNA, 585 bp, Homo sapiens
  misc_feature: GZ8MTXP02GY2FK.21.25.C03.1.454.CMB.2.raw
  modified_base (275)..(275): a, c, t, g, unknown or other
  modified_base (286)..(286): a, c, t, g, unknown or other
  modified_base (328)..(328): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccangctgaagcagacgcctaccaaactcctcatctatggtaaccngcaatccgaccctcgacggggtcccctggacccgtattcctcgtcgggctacccgaaagtctcggccacccgtcacgtccctcccgtggtcacgtcgtcgtcgggcctccgaggtctagaccgagtcggaggtcgtagtatttacgttaattcgacctacggttcctatcgtaaacctaacctacccgtacggtcggtttcgggtttttcggcgtttcgggttccgggacgggtccgggtaacccgtaacggtcccg

SEQ ID NO: 401738 - DNA, 601 bp, Homo sapiens
  misc_feature: GZ8MTXP02ITHN6.21.25.C03.1.454.CMB.2.raw
  modified_base (273)..(273): a, c, t, g, unknown or other
  modified_base (282)..(282): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagacaggccatgctggagattgctgagtgctgcctnttgcgccangctgaagcagacgccctacccaaacttcctacattctaagtacggtaaccagacaacgtccggccctacgacggggtcccctgacccgtattcctcgtcggcctaccgaaacgttccgtcggccacctcgaccgtccctcccgtggtcacgtccgcgtcgggcctccgacggtctacgacggtactggacggtctagtatttattagttcgaccgttacgtacccttataccgaaacctacctacccgttggttaccggtttgggttttaacggtcgttcgggttccggggaccgggtacgggaaccgtacggtcccgg

SEQ ID NO: 401739 - DNA, 591 bp, Homo sapiens
  misc_feature: GZ8MTXP02FKIJH.21.25.C03.1.454.CMB.2.raw
  modified_base (296)..(296): a, c, t, g, unknown or other
  modified_base (361)..(361): a, c, t, g, unknown or other
  modified_base (371)..(371): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagattgtcctgagtgctgccttctgtcgcccacagctgaancagcgcctaccaaactctacatctatggtaacccagtacaagtccggccctacgacggggtcccngacctattcncgtcggctacaagtcgtggccacctcacgtccctcccgtggtctacgtccgtcgtcgggcctccgaggtctcgacgtagtcgaggctagtattattagttcgacctacgttaccctataccgtaaacctaacccgtacccgtacggttcccggtttgggtttttcggccgtttacgggtttcccggggtccggggaccgggtaaacccgaacggtcccgg

SEQ ID NO: 401740 - DNA, 580 bp, Homo sapiens
  misc_feature: GZ8MTXP02HMMAE.21.25.C03.1.454.CMB.2.raw
  modified_base (316)..(316): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagtattgcctgagtgctgcctcgttgcgcccagagctgaagcagacgcctaccaaactcctnatctataggaaccagacaactccggccctcggacggggtcccctaggtaccgtattccgtcgttcggcctacccgagttcgtacggcctaccgtcaccgtccctcccgtgtcacgtccgcgtcggcctcgaggtctacgacgtagtgacgtcgtagttatttagttacgtacgtccgtacgttacctagtacgaacctaaccgtacccgttgttccggtttggtttcgcgttacggttccgggcgggtccggaactacggtccg

SEQ ID NO: 401741 - DNA, 620 bp, Homo sapiens
  misc_feature: GZ8MTXP02JOBB4.21.25.C03.1.454.CMB.2.raw
  modified_base (293)..(293): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagacgtgggcccaggaccctgtgcagtgagcgaggagagtggaggaggagaggagaccaggccagtgctggagattggtacctgagtgctgccttcgtgtcgcccangtcgtagaagcagacgccctaccaaactcctactatcgtatacggtaaaccagactaacgtcccggtccctacggaccggggtccctgacccgtacttccgtcgttcggcctaccgtaacgtccgtcggaccctaccgtccaccgtccctccccgtggtcctacgtccgcgtacgggtcctccgacggtcgtacgacgagtggacggtcgtagttatttacgttacgtcgaccgtacgttaccctagtaccgaaacctaaaccgtccgttacggttcggtttggtttcggcgttcggttcggggccggtaccggtacacggttcccg

SEQ ID NO: 401742 - DNA, 714 bp, Homo sapiens
  misc_feature: GZ8MTXP02GCLL2.21.25.C03.1.454.CMB.2.raw
  modified_base (275)..(275): a, c, t, g, unknown or other
  modified_base (285)..(285): a, c, t, g, unknown or other
  modified_base (293)..(293): a, c, t, g, unknown or other
  modified_base (326)..(326): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccanagctgaancagagcctcaaactcctcatctatggtaaaccngcaatcggccctcgacggggtccctgacccgtatttcctacgtcggtcctacccgtaaagtccttcggggacccaaccccgttaccgaaccgggtcccccttcccccgttggggtttacccaacgttccccgggccgttcgggggacccttccccggaacggggtccgttaacgggtaacccgggaaacgttcgggaaggggtcccttagggttaaacgtttaacgtttaatttcggacccgtaaacggtttccccttaaagttacggaaaccctaaaccctaacccccgttaggttacccgggttttggggttttttaaccggtccgtttacgggggtttcccggggtaccgggggtacccggggaaacccggtaaacggttcccgg

SEQ ID NO: 401743 - DNA, 566 bp, Homo sapiens
  misc_feature: GZ8MTXP02HZ44Z.21.25.C03.1.454.CMB.2.raw
  modified_base (292)..(292): a, c, t, g, unknown or other
  modified_base (306)..(306): a, c, t, g, unknown or other
  modified_base (365)..(365): a, c, t, g, unknown or other
  modified_base (369)..(369): a, c, t, g, unknown or other
  modified_base (381)..(381): a, c, t, g, unknown or other
tcagtcgtcgctcgcacgaccggtgctcgatttagtagtgtagatttgggtttgggggctgttcctggaagttgctgataccagtgcacatcaaaaaggtgaccccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagattgtcctgagtgctgcctcgttgcgccccacngtctagaagcaganccctaccaaactcctcatctatggtaacagcaagtccgccctcgacgggtcctgaccgnttcncgtgctcagtcngcactcacgcctcctgcatcgctgggcctcaggtctggacgatcggaggcttaggtaactttattagttcgtaccgtaacgtcctaaatcgaaacctaaaccctacccgttcggttcgttttcgggttttcggtccgtttcgggtttcccgggacgggggtaccgggaaccgtaaacggtcccgg

SEQ ID NO: 401744 - DNA, 587 bp, Homo sapiens
  misc_feature: GZ8MTXP02H4BU7.21.25.C03.1.454.CMB.2.raw
  modified_base (289)..(289): a, c, t, g, unknown or other
  modified_base (318)..(318): a, c, t, g, unknown or other
  modified_base (331)..(331): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtcgctaggagattgcctgagtgctgccttctggcgccccanagctagaagcagacgccctacaaactccnatcaatggtaacngacagcggccctggaccgggtcctgacctattctctggcctacgacgtctcggcaccgtcacgtccctcccgtcggtcacgtcgcgtacggccgtccgaggcgtacggacggtacgtacggaacggtcttaggaattttaacgttacgtacgtacccgtacggttccctaagttacgaaaccctaaccgtaccgtacggttcggtttcggttttcggccgttacgggttccggacggggccggtacgaacgtccgg

SEQ ID NO: 401745 - DNA, 582 bp, Homo sapiens
  misc_feature: GZ8MTXP02IMR9C.21.25.C03.1.454.CMB.2.raw
  modified_base (272)..(272): a, c, t, g, unknown or other
  modified_base (281)..(281): a, c, t, g, unknown or other
  modified_base (466)..(466): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagagagacaggcatgctggatattgtctgagtgctgcctnttgcgccanagctagaaagcagacgccctaccaaactccacattctagtaggtaaccagcaacgtccggccctggacgggtccctgacccgtatttcctcgtggcctaccgtaagtccgtaggcccacctcgacgtccctccgtggtccagtccgcgtcgggtccctacgacggtctaggacgtagaggcggtnttagtaatttattacgtcgacccttagtcccttaagcgaaaccaaccgtacccgttgttccggttttgggttttcggcgtttcgggttcgggaccggtccgggaaactacggtccg

SEQ ID NO: 401746 - DNA, 658 bp, Homo sapiens
  misc_feature: GZ8MTXP02F9ESN.21.25.C03.1.454.CMB.2.raw
  modified_base (276)..(276): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtcctgagtgctgcctnttgtcgccacngctgaagcagacgcctaccaaactcctcagtctatcggtaaccagcaatccgggccctcgacggggtccctagaccgtattcctctggccttacctaaagtccgttcggcctaacccgttcaacgtccccttccccgttggtccacgtccgcgtcggggcccttccggacggtccgtacggaaccggtagtacggacggtcgttaggtatttattacgtttcggaccctaacggttaccctaaagttacggaaaccctaaaacccgtaaccccgttcggtacccggtttttagggtttttcggtaccggtttaccggggtttcccgggggcccggggtacccggggtaaacccgaaacggggttaccccgg

SEQ ID NO: 401747 - DNA, 591 bp, Homo sapiens
  misc_feature: GZ8MTXP02JVVUA.21.25.C03.1.454.CMB.2.raw
  modified_base (255)..(255): a, c, t, g, unknown or other
  modified_base (276)..(276): a, c, t, g, unknown or other
  modified_base (288)..(288): a, c, t, g, unknown or other
  modified_base (295)..(295): a, c, t, g, unknown or other
  modified_base (300)..(300): a, c, t, g, unknown or other
  modified_base (314)..(314): a, c, t, g, unknown or other
  modified_base (327)..(327): a, c, t, g, unknown or other
  modified_base (360)..(360): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggaggagaggagaccaggccagtgctgganattgtcctggagtgctgcctnttgtcgccccangctgaancagcncctacaaactcctnatctatgtaaccngcatccggcctcgacggggtccctgaacccgtnttccgtcgtcggccttaccgaacgttcgtacggaccctacctcgaccgtccctaccgtcggtacctcgttccgcgtcgggtcctaccggcgcgtagaccggtagtcggaacggtcttaggtatttagttacgtttacgccgttaacgtccctaaagtcgaaaccaaaccgtcccgttggtcgttttggtttcggcgtttacggtccgggcggtaccgggactacggtccgg

SEQ ID NO: 401748 - DNA, 775 bp, Homo sapiens
  misc_feature: GZ8MTXP02I30NL.21.25.C03.1.454.CMB.2.raw
  modified_base (276)..(276): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcctgagtgctgcctnttgtcgcccangctgaagcagacgccctacccaaactcctacattcctaagtacggtaaacccaggacctaaacgttccccgggacccccttacggaacgggggttccccctacgggtaacccggtacttttcccgtccgttacggggcccttacccgtaaacgttccgttaccgggaccctaaaccccgttccgaacccggtccccctttacccccgttacgggttccctaaccgttcccggtacccgttacgggggtcccctttacccggaacgggtccgtacgggtaaaccggtacgttacgggaacggtccgttaggttaacttttaagtttacgtttaccgacccgttaacggttacccgttaataccggtaaaacctaaacccgtaaccccgttacgggtttccggttttacggggtttttccgggtacgttttaccgggggtttccgggggacccgggggtaccggggtaacccgtaaaacgggttccccgg

SEQ ID NO: 401749 - DNA, 691 bp, Homo sapiens
  misc_feature: GZ8MTXP02I0ZGG.21.25.C03.1.454.CMB.2.raw
  modified_base (289)..(289): a, c, t, g, unknown or other
  modified_base (336)..(336): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactcgggcccaggaccctgtgcagtgagcgaggagagtgaggaggagaggagaccgaggccatgctggagtattgtcctgagtgctgcctcttgtcgcccanagctgaagcagacgcctaccaaactcctacattctatcggtaaaccngacaagtcccggcctacggacggggtccctgacccgtattcctcgtcgggtacctacccgtaagttccgtcggccctaacccgttccaccgtccccttccccgtgggttcccaacgttccggccgttcggggcccttacccggaacgggtccgtacgggaacgtacgttacgggacggtactaggttaattttaacgtttaacgtttcggacccttaacggttaccttaaacgtacggtaaaccctaaacccgttaacccgttcggggtttaccggtttttcggggtttttcggtccggtttacggggtttcccgggggaccggggttacccgggaaccgtaaacggttccccgg

SEQ ID NO: 401750 - DNA, 520 bp, Homo sapiens
  misc_feature: GZ8MTXP02FM3VP.21.25.C03.1.454.CMB.2.raw
  modified_base (286)..(286): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgcctcttgtcgcccangctgaagcagacgcctaccaaactcctcatctatggtaaccagcaagtcggccctgacggggtccctgaccgtattctcgtggctaccaagtctcggccacctcacgtccctcccgtggtcagtcgcgtgggcctcgacgctgacgagtgagtctgtattattagtgacctacgtcctagtcaacaaacctcccgtgtcgttgtttcggcttcggtcggcgtcggacgacgtcg

SEQ ID NO: 401751 - DNA, 566 bp, Homo sapiens
  misc_feature: GZ8MTXP02GJSVM.21.25.C03.1.454.CMB.2.raw
  modified_base (275)..(275): a, c, t, g, unknown or other
  modified_base (286)..(286): a, c, t, g, unknown or other
  modified_base (316)..(316): a, c, t, g, unknown or other
  modified_base (332)..(332): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccanagctgaagcagacgcctaccaaactcctanatctagtcggtaaccngacaagtccggcccttacgacggggttccccctaggacccgtatttcctcgtgggccttacccgtaaagtccgttacggcccaacccgttcgaccgtcccctccccgttggtccacgtccgcgtcggggcctccgacggctagacgtagtcgaggcttagtatttattatcgctagtcctatcgaacaccacccgtgtcgtttggtttgcgttggttcggcggcggacagtccg

SEQ ID NO: 401752 - DNA, 538 bp, Homo sapiens
  misc_feature: GZ8MTXP02GOJSM.21.25.C03.1.454.CMB.2.raw
  modified_base (275)..(275): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtgcccanagctgaagcagagcctaccaaactcctcatctatcggtaaccagacaatccggccctcgacggggtccctgaccgattctctggctccaagtctggcacctcacgtccctccctgtcactcgcgtgggctccgaggcgtcgacgatcgaggtcgtgtattattatgaccctagtcctagtacgaaccaacgtacccgtcgtccgtttggttttcggtcgttcgggttcggcgggtccgggacgaacggtccgg

SEQ ID NO: 401753 - DNA, 555 bp, Homo sapiens
  misc_feature: GZ8MTXP02FYBXO.21.25.C03.1.454.CMB.2.raw
  modified_base (288)..(288): a, c, t, g, unknown or other
  modified_base (302)..(302): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgctggagtattgtcctgagtgctgcctcttgcgcccangctagaagcagacncctaccaaactcctacatctaagtaggtaaccagaccaatcccggaccctcgacggggtccctagaccgtattcctcgtcggcctaccgagtcgtcgccacctcacgtccctccgtgtcagtcgcgttcgggcctcgacggtctaggacgagtgaggtctagtatttatatcgacctacgttacctatcgaaactaaccgtacccgtggtcgtttaggtttcggcgttcggttcggcggtacggacacgtccg

SEQ ID NO: 401754 - DNA, 633 bp, Homo sapiens
  misc_feature: GZ8MTXP02FQ2BF.21.25.C03.1.454.CMB.2.raw
  modified_base (288)..(288): a, c, t, g, unknown or other
  modified_base (336)..(336): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagtattgtcctgagtgctgcctctgtcgcccangctagaagcagacgccctaccaaactcctacatctagtaggtaaaccngaccaagtccggccctacggacggggttcccctaggaccgtattcctcgtcggcctacctaagtcgtcggcctacctcaccgtccctcccgtggtcctacgtcgcgtcgggcctaccgagggtcctacgggaacgtgtacggcggtactaggttaactttaagttacgttcgacctacgttaccctagtacgtaaaccctaaacccgttacccgttcggttcggtttttacgggttttccggtcggtttacgggtttccgggggaccgggtacccgggaaaccgtaacggttcccgg

SEQ ID NO: 401755 - DNA, 652 bp, Homo sapiens
  misc_feature: GZ8MTXP02JXI46.21.25.C03.1.454.CMB.2.raw
  modified_base (256)..(256): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagnttgctgagtgctgcctgttgtcgcccanagctgaagcagacgcctaccaaactcctacaatcctaagtacggtaaccagacaaacgtcccggaccctcggtaacggggtcccctagggtaaccccgtatttcccgcgttcggtaccctacccgtaaagtcccgtcggaccctaacccgtcgaaccgtccctccccgtggtcccagttccgcgtcggggcctaccggaggtctaggaacgagtacggaacggtctaggtaatttagttagtcgaccgttacggttaccctaagtaccgaaacctaaccgtaccccgttggttaccggttttgggtttttcggccggttttcggggttccggggacccggggtccgggtaaacccgtaaggttcccgg

SEQ ID NO: 401756 - DNA, 641 bp, Homo sapiens
  misc_feature: GZ8MTXP02H9ZVQ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacgaggccatgctggagtattgtccgtgagtgctgccttcgttgtcgcccagagctagaacgcagacgccctaccaaacttcctacatctagtacggtaaaccagaccaacgtccggaccctacggaccggggttcccctaggtaacccgtactttccgtcgtcggaccttaccgtaacgttcgtcggcctaccctcaccgtcccttcccgtcggtccacgtccgtcgtcgggtcctccgaggtcgtacggacgtagtcggaggtactagttatttagttacgtcgtacctacgttaccttacgtacgtaaacctaaccgtacccgttcggttacggttttcgggttttcggtcgtttcggggttaccggggaccgggtacccgggtaccgtaacggtcccgg

SEQ ID NO: 401757 - DNA, 683 bp, Homo sapiens
  misc_feature: GZ8MTXP02G3MXQ.21.25.C03.1.454.CMB.2.raw
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccanagctgaagcagacgccctaccgaaactcctacattcctaagtcggtaaacccagacctaaacgtccggaccccttacggaacgggggtccccctggaacccgtatttccgtcgtcgggcctaccctaaagttccgtcggcctaacccgtcaccgtccccttccccgtggtcctacgtccgcgtcggggcctccgaggtcctacggacgtagtacggacggtcttaggtaactttagttagtttcgacccgttaacgttacccttagtaccggtaaacctaaaccctaacccccggtttggttacccgggtttttgggttttttcgggtcccgttttacgggggtttcccgggggaccggggtacccgggggtaacccgtaaacggggttaccccggg

SEQ ID NO: 401758 - DNA, 606 bp, Homo sapiens
  misc_feature: GZ8MTXP02HRDWA.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggcccagacaccgagggcggctgcgtcagcacagactgggcccaggaccctgtgcagtgagcgaggagagtgaggaggagacggagacaggccatgctggagattgctgagtgctgcctcttgcgccacagctgaagcagacgcctacaaactctacgatctataggaaccagacaagtccggccttgaacggggtccctagacccgtatttccgtctgggaccttacccgaaacgtttcgtcgggccaacccgttcgaaccgtccctcccccgttcggttccacgttccgcgtcggtccgtccgaacggaccgttcgacggtacgtacggaacggtcgtagtaatttagtttaattacgtccgtacgtacgttacttacgtaactaaaccaaccctacgttccgttcggttttggttcgtacggtttcggtcggcggtcggtacgtaaaccgg

SEQ ID NO: 401759 - DNA, 571 bp, Homo sapiens
  misc_feature: GZ8MTXP02I9W6A.21.25.C03.1.454.CMB.2.raw
  modified_base (273)..(273): a, c, t, g, unknown or other
  modified_base (278)..(278): a, c, t, g, unknown or other
  modified_base (283)..(283): a, c, t, g, unknown or other
  modified_base (515)..(515): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcagtgctggagattgctgagtgctgcctntgtcncccanagctagacgcagcgcctaccaaactcctcatctagtacggtaaccagactaactccggccctacggaccggggttccctcgaacccgtatttccgtcgtcggtcctaccgtaaaggttcctacggaccctaacctccgaaccgtcccttccccgtggtccacttccggcgttcgggccctccgaggtcgtacgacgagtgaggtctagtattagttatcgctacgtacctanacgacaactccgtgtcgtttggtttcgacgttcggtacggcggtacggacagtccg

SEQ ID NO: 401760 - DNA, 581 bp, Homo sapiens
  misc_feature: GZ8MTXP02HEAFD.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggagagaggagacaggccatgcgtggagtattgtcctgagtgctgccttcttgtcgcccagagctagaagcagacgccctacaaaacctcctacacttctagtacggtaaacccagaccaagtccggccctacggacggggtccctgaccctattcctcgtcgccttaccaacgtcgtcggccacctcacgtccctccctcggtctacgtccgcgtcgggcctccgaggtcagacgagtcgagtctagtatttattagtcgactacgtacctatacgaacaaaccctaccgtcgttcggtttgggtttcggtcgtttcggggttccggaccgggtccggaaccgtaacggtccg

SEQ ID NO: 401761 - DNA, 701 bp, Homo sapiens
  misc_feature: GZ8MTXP02H90R1.21.25.C03.1.454.CMB.2.raw
  modified_base (255)..(255): a, c, t, g, unknown or other
  modified_base (261)..(261): a, c, t, g, unknown or other
  modified_base (271)..(271): a, c, t, g, unknown or other
  modified_base (279)..(279): a, c, t, g, unknown or other
  modified_base (308)..(308): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagtgaggaggagaggagaccaggccatgctggagntgctgngtgctgcctntgcgccangctgaagcagacgccctaccaaactcctnattctatacggtaaccagaccaaacgtccggcccctacggaaccggggttccccctagggtaacccgtactttccgtccgtcgggtaccttacccgtaaacgttccgtccgggtaccctaaccccgttcccgaacccgttcccccgtttccccggttcgggtccctaacgtttcccggccgttccgggggtcccttacccggaacgggtccgttacgggaaccggtaacgttgggaaacgggtccttaggttaatttttaattaagtttcgacccgttaacgttacccttaagtaccgaaacctaaccgtaccccgttggttccggttttggggtttttcggcgtttcggggtttccgggaccggggtacccgggtaaccgtaacggtcccgg

SEQ ID NO: 401762 - DNA, 489 bp, Homo sapiens
  misc_feature: GZ8MTXP02FIVMD.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaaccagcaatcggccctcgaggggtccctgaccgtattctctggctccaagtctggcacctcagccctccctggtcatcgctgggctccaggctgacgatgaggctgattattattgcagtcctatcgacaacacctgcgttggtttgcttgtcggcggcggacagtcg

SEQ ID NO: 401763 - DNA, 571 bp, Homo sapiens
  misc_feature: GZ8MTXP02FT4NA.21.25.C03.1.454.CMB.2.raw
  modified_base (274)..(274): a, c, t, g, unknown or other
  modified_base (285)..(285): a, c, t, g, unknown or other
  modified_base (327)..(327): a, c, t, g, unknown or other
  modified_base (365)..(365): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccangctgaagcagcgcctaccaaactcctacatctatggtaaccngacaatccggcctcgacggggtccctgaccgtattccncgtggcctaccaagtctcggccacctcacgtccctcccgtggtccagtccgcgtcgggcctccgacggtctggaacgtagtcggaggtcttagtaatttattagttcgacctacgtacctagtacgaacctaaacctcccgttgtccggtttgggttttcggcgtttcggttccggggaccgggtacgggtaccgtaacggtcccg

SEQ ID NO: 401764 - DNA, 625 bp, Homo sapiens
  misc_feature: GZ8MTXP02F3JMA.21.25.C03.1.454.CMB.2.raw
  modified_base (279)..(279): a, c, t, g, unknown or other
  modified_base (289)..(289): a, c, t, g, unknown or other
  modified_base (319)..(319): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtggagtattgtcctgagtgctgcctnttgcgcccangctagaagcagacgcctaccaaactcctanatctagtaggtaaccagacaacgtccggaccctcggacggggtcccagacccgtattcctcgtcggtcctaccgtaacgtctcggacctacctcacgtccctccgtgtcacgtcgcgttcgggccttccggaggtcgtacggacgtagtcggtacggtcgttagtaactttagttacgttacggtacctacgttacctagttaccgaacctaaaccgtacccgttcggttaccgggttttcgggtttttcggaccggtttcgggttcccgggggacgggtaccggggtaaccgtaacggttcccgg

SEQ ID NO: 401765 - DNA, 572 bp, Homo sapiens
  misc_feature: GZ8MTXP02JEYCW.21.25.C03.1.454.CMB.2.raw
  modified_base (275)..(275): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgcctgagtgctgcctntgtcgcccanagctgaagcagacgccctaccaaactcctacatctagtcggtaaccagcaacgtccggccctacggacggggtcccctggaacccgtatttccgtcgtcggcctaccgtaaacgtcgtcggaccaccgtcaccgtccctcccgtcggtcacgtcgcgtcggcctccgaggctgacgtagtgaggctagtatttattagtcgtactacgtcctatcgaaccaaccgtaccgtcgtcggtttggttttcggcgttcggttccgggcgggtccgggaccgtaacggtccg

SEQ ID NO: 401766 - DNA, 646 bp, Homo sapiens
  misc_feature: GZ8MTXP02IQ2QR.21.25.C03.1.454.CMB.2.raw
  modified_base (277)..(277): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgcctnttgcgcccanagctagaaagcaagacgccctacccaaaacttcctcaactctaaatacggtaaaaccccagacctaaaagtcccgggaccccttacggaaccgggggttccccctaggaaccccgtatttcccgtccgtgggtcccttacccgaaagtcgtcggaccaccgtacacgtccctccccgtggtaccacgtccgcgttcggggcccttaccgacgggtcctaggaccggtaagtcgggaggtactaggttaaactttatttaacgttcgacccgtagttccctaatcgaaaccaaacctacccgttgtccggtttggttttcgcgttacgggttcgggccgggccggtaaccgaacgtccgg

SEQ ID NO: 401767 - DNA, 588 bp, Homo sapiens
  misc_feature: GZ8MTXP02GEEGW.21.25.C03.1.454.CMB.2.raw
  modified_base (377)..(377): a, c, t, g, unknown or other
  modified_base (412)..(412): a, c, t, g, unknown or other
tcagtcgtcgctcgcacgaccggtgctcgattagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtaggagtattcgtcctggagtgcctgcccttcttgtcgccccaacagctagaagcagacgcctaccaaactcctacatctatcggtaaccagacaacgtccggccctcgacggggtccctgaccgtnttcctcgtcggacctcgaagtcgtcgacaccctcncccgtcctcccgtggccacgtcgcgtcgggcctaccgacggtctacggacgagtgacggtcttgtaatttagttagttccggacctacggtccttaatacgaaccaacctacccgttggtaccggttttggtttcggccgttcgggttccggcgggtaccggaccgtaaggtcccg

SEQ ID NO: 401768 - DNA, 592 bp, Homo sapiens
  misc_feature: GZ8MTXP02FW08M.21.25.C03.1.454.CMB.2.raw
  modified_base (277)..(277): a, c, t, g, unknown or other
  modified_base (282)..(282): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagtattgtcctgagtgctgcctnttgcncccangctgaagcagacgcctaccaaactcctacatctataggtaacagacaacgtccggccctcgacggggtccctagacccgtattccgtcgtcggcctacccgtaagtcctcggcctaccgtccacgtcccctcccgtcggtacctacgtccgcgtcgggcctaccgacggtctacggaacgtagtcggaggtcttaggtaatttattacgttcgacctacgttcctaatccgaaactaaccgtacccgttgtcggtttggttttcggcgtttcggttccgggccgggtaccggaccgtacgtccgg

SEQ ID NO: 401769 - DNA, 584 bp, Homo sapiens
  misc_feature: GZ8MTXP02HU4XY.21.25.C03.1.454.CMB.2.raw
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccactaggctgaagcagacgcctaccaaactcctcatcctatacggtaaccagccaatccggccctcgacggggtcccctggacccgtattccgtcgtcggcctacccgaaagtccgtcggccctacctccacgtccccttcccgtcggtcctagtccgtcgtcggggcctccgacggtctggaccgatggaggtctgtatttacttattcgcctacgttcctatacgaacaacctaccgtcgttcggttggtttttcggcggttcggttccgggtcgggtccgggtaccgtaacggtcccgg

SEQ ID NO: 401770 - DNA, 573 bp, Homo sapiens
  misc_feature: GZ8MTXP02I3OS5.21.25.C03.1.454.CMB.2.raw
  modified_base (283)..(283): a, c, t, g, unknown or other
  modified_base (292)..(292): a, c, t, g, unknown or other
  modified_base (314)..(314): a, c, t, g, unknown or other
  modified_base (326)..(326): a, c, t, g, unknown or other
  modified_base (358)..(358): a, c, t, g, unknown or other
  modified_base (362)..(362): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggagagaggagaccaggccagtgctggatattgcctgagtgctgcctgttgcgcccanagctagaancagacgccctaccaaactcctnatctatgaaccngacagtccgcctcggacgggtcctagaccgtnttcngtcgctacaagtcgtcgctaccgtcacgtccctccgtgtcacgtcgcgtcgggcctcgagtcgtagacgtagtcggacggtctagtaatttagttagttcgaccttacggttacccttaagtaccgaaaccaaacccttacccgtggttccggtttgggtttccggcgtttacgggttccggggacgggtaccgggtacctaacggtccgg

SEQ ID NO: 401771 - DNA, 527 bp, Homo sapiens
  misc_feature: GZ8MTXP02JFD1M.21.25.C03.1.454.CMB.2.raw
  modified_base (274)..(274): a, c, t, g, unknown or other
  modified_base (277)..(277): a, c, t, g, unknown or other
  modified_base (283)..(283): a, c, t, g, unknown or other
  modified_base (326)..(326): a, c, t, g, unknown or other
  modified_base (363)..(363): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctntgngcccangctgaagcagagcctaccaaactcctcatctatcggtaaaccngcaatccggccctgacggggtccctgacccgattccnctggcctcaagtctggcacctcacgtccctcccgtggttccatcgcgtcgggcctccgaggctggacgatgacggctgtatttattagttcgcctagtacctatacgaactaaccacccgtgtccgttggtttgcgttggttcggcggtcggaccgacgtaccg

SEQ ID NO: 401772 - DNA, 642 bp, Homo sapiens
  misc_feature: GZ8MTXP02H2P98.21.25.C03.1.454.CMB.2.raw
  modified_base (273)..(273): a, c, t, g, unknown or other
  modified_base (281)..(281): a, c, t, g, unknown or other
  modified_base (315)..(315): a, c, t, g, unknown or other
  modified_base (388)..(388): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagacaggccatgctggagattgcctgagtgctgctntgcgccanagcagaacgcagacgcctacccaaaacttcctanaaatctaagtggtaacccagacctaacgtccggaccctcggacggggttcccctagggaaccctacttttccncgtttacgggccttaaccgtaacgttccgtacggtaccaacccttccgaccgtcccgttccccttcggtacctacgttcgccgttcggggcctccgacggtcgtacggacgtagtcggaggtacgttagtatttattacgtcgtaccgtacgttaccttaacgtacgtaaacctaaccgtacccgtcgtttcggtttcggttttcggtccggttcgggttccggggtccgggtaccgggtaaccgtaacggtcg

SEQ ID NO: 401773 - DNA, 521 bp, Homo sapiens
  misc_feature: GZ8MTXP02JOIKE.21.25.C03.1.454.CMB.2.raw
  modified_base (274)..(274): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgtcctgagtgctgcctnttgtcgccacagctgaagcagacgcctaccaaactcctcatctatggtaaccagacaactccggccctcgacggggtccctgaccgtattcctcgtcggcctcaaacgtctacggccacctcacgtccctcccgtggtcactcgcgtcgggcctcgaggtctgacgatgagctgtattattatcgctacgtcctatacgacacaccgtgtcgttggtttgcgttcggttcggcggtcggacgagtcg

SEQ ID NO: 401774 - DNA, 549 bp, Homo sapiens
  misc_feature: GZ8MTXP02IXQUC.21.25.C03.1.454.CMB.2.raw
  modified_base (274)..(274): a, c, t, g, unknown or other
  modified_base (278)..(278): a, c, t, g, unknown or other
  modified_base (283)..(283): a, c, t, g, unknown or other
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgatgctgcctntgcncccangctgaancagagccctacaaactcctcatctatggtaaccagcaatccggcctcgacggggtccctgacccgtatttcctcgtggcctaccgaagtcgtcggtaccaccgtcacgtccctcccgtggtcactcgcgtcgggcctccgaggtctggacgagtggacggtctagtaactttagttactcgtacctacgtcctaatcgaacctacaccgttcgtcgtttggttttcggcgttggttccggcgggacggacgacgtaccg

SEQ ID NO: 401775 - DNA, 590 bp, Homo sapiens
  misc_feature: GZ8MTXP02ID3W0.21.25.C03.1.454.CMB.2.raw
  modified_base (291)..(291): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtggagattgtcctgagtgctgccttcgttgtcgccccanagctgaagcagacgccctaccaaactcctacatctataggtaaccagacaagtccggccctacgacggggtcccctacggaccgtactttccgtacgtcggacccttacccgtaaacgtccgtcggaccctacccgtccgaccgtcccctcccgtggtccacgtccgcgtcgggcctccgaggtcctagacgagtggacggctgtatttacttagttcgacctacgtaccttatacgaaccaacctacccgtcgttcgttggtttcgcgttcggtccggcggtaccggacgtacgtccg

SEQ ID NO: 401776 - DNA, 519 bp, Homo sapiens
  misc_feature: GZ8MTXP02GZMO1.21.25.C03.1.454.CMB.2.raw
  modified_base (254)..(254): a, c, t, g, unknown or other
  modified_base (285)..(285): a, c, t, g, unknown or other
  modified_base (313)..(313): a, c, t, g, unknown or other
  modified_base (326)..(326): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtcctgagtgctgcctcttgtgcccacngctgaagcagacgcctaccaaactcctnatctatggtaacngcaatccggcctcgacggggtccctgacctattcctctggcctaccaagtctggccacctcacgccctccctggtccagtcgcgtgggtcctcgacggtctagacgatggaggctgtattattattcgacctagtcctaatcgaacaaactccctagcggtttggtttgcttcggttcggcgcggaccagtcg

SEQ ID NO: 401777 - DNA, 563 bp, Homo sapiens
  misc_feature: GZ8MTXP02JEL7X.21.25.C03.1.454.CMB.2.raw
  modified_base (276)..(276): a, c, t, g, unknown or other
  modified_base (286)..(286): a, c, t, g, unknown or other
  modified_base (329)..(329): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtcctgagtgctgcctntgtcgcccangctgaagcagcgcctaccaaactcctacatctatcggtaaccngactaacgtccggtcccctcgacggggttcccctacgaccgtattcctcgtacggcctaccgaagtctcggccacctcacgtccctcccgtggtcacgtccgcgttcgggcctccgacggctcgacgatggagctgtatttattagtcgacctagttcctatacgaacctaacctaccgtcgtcggtttcggttttggcgttcggttcggggcggtaccgggacgtacgtccgg

SEQ ID NO: 401778 - DNA, 586 bp, Homo sapiens
  misc_feature: GZ8MTXP02I22LH.21.25.C03.1.454.CMB.2.raw
  modified_base (277)..(277): a, c, t, g, unknown or other
  modified_base (281)..(281): a, c, t, g, unknown or other
  modified_base (286)..(286): a, c, t, g, unknown or other
  modified_base (301)..(301): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagactgggcccaggaccctgtgcagtgagcgaggagagtgaggaggagaggagaccaggccatgctggagattgcctgagtgctgcctntgcncccanagctagaagcagacncctaccaaactcctacattctagtaggtaaccagacaacgtccggaccctcggacggggtccctaggaccgtattcctcgtcggacctaccgaagtcgtcggcctacctacacgtccctacccgtggtcacgtcgcgtcgggccttccgacggtctacggacgtagtcggacggtctaggttaatttacttacgttcgacctacgtcctaagtacgaaacctaaccgtcccgtagtcggtttggtttcgcgttcggttcgggccggtaccgggtacaacggtccg

SEQ ID NO: 401779 - DNA, 653 bp, Homo sapiens
  misc_feature: GZ8MTXP02GBSKW.21.25.C03.1.454.CMB.2.raw
  modified_base (281)..(281): a, c, t, g, unknown or other
  modified_base (291)..(291): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtgggcccaggaccctgtgcagtgagcgaggagagtggaggaggagaggagaccgaggccatgcgtggatattgtcctgagtgctgcctnttgcgcccangctagaagcagacgcccctaaccgaaacctcctctacttctaagtacggtaaaccacgactaacgtcccggtcccgtacggacggggtcccctaggacccgtatttccgtcgtcgggtaccttaccgaacgttcgtcggacctaccctcgaccgtcccctcccgtaggtccacgtccgtcgtcgggtccctaccgaggtctacggaccggtatacgggtacgtattacgttaatttacttaggtccacgtacggtttcctacgtaccgaaacctaaacccgttccgttcggttcgggtttttggtttcgggtcgtttcggggttccgggccggggtaccggtaaacccgtcggttaccccgg

SEQ ID NO: 401780 - DNA, 600 bp, Homo sapiens
  misc_feature: GZ8MTXP02HZ1P5.21.25.C03.1.454.CMB.2.raw
  modified_base (256)..(256): a, c, t, g, unknown or other
  modified_base (275)..(275): a, c, t, g, unknown or other
  modified_base (286)..(286): a, c, t, g, unknown or other
  modified_base (460)..(460): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccctggggccccagacaccgagggcggctgcgtcagcacagactgggcccaggaccctgtgcagtgagcgaggagagtgaggaggagaggagaccaggccatgctgganattgcctgagtgctgcctnttgtcgcccanagctagaacgcagacgccctacaaactcctcatctataggtaaccagacaactccggccctaggaccggggtccctaggaaccgtactttcctcgttcggactttcccaaagttcgtcggcccacctccacgtccccttcccgtggtccacgttccgcgtcgggccttcccggnggtcgtaggacgtagtggacggtacttagtatttacttatcgtacctacgttacctatacgaacctaacctccgttacggttcggtttggttttcggtcgttacgggttccggggtaccgggtaccgggtactacggtcg

SEQ ID NO: 401781 - DNA, 522 bp, Homo sapiens
  misc_feature: GZ8MTXP02JGVOP.21.25.C03.1.454.CMB.2.raw
  modified_base (255)..(255): a, c, t, g, unknown or other
  modified_base (274)..(274): a, c, t, g, unknown or other
  modified_base (284)..(284): a, c, t, g, unknown or other
  modified_base (355)..(355): a, c, t, g, unknown or other
  modified_base (367)..(367): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgcctgagtgctgcctnttgcgcccanagctgaagcagagccctaccaaactcctcatctatggtaaccagcaagtccggccctacgacggggtcccngacccgattccnctggcctcaagtctggcacctcacgccctccctggtcacgtccgcgtcgggcctccgacggtctacgacgtatgaggtctgtattattatcgctacgtccatcgaacaccacctagtcgttggtttcggcttcggttcggcggtcggacagtccg

SEQ ID NO: 401782 - DNA, 714 bp, Homo sapiens
  misc_feature: GZ8MTXP02F7EWA.21.25.C03.1.454.CMB.2.raw
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctaccaaactcctacatctatggtaaccagacaatccggccctcgacggggtcccctagacccgtatttccgtcgtcgggtacctacccgtaaagttccgttcggaccctaccccgttacgaacccggtcccccttaccccgttcgggtaccctacgttcccggtaccggttccgggggtacccttcccggaacgggtcccgttacggggaacccggtagtacgggtaacgggtccttagggttaacttttaagtttaacgtttcggtaccctaacggtttaccccttaaagttaccggaaacccttaaacccgtaccccgtttacgggttccgggtttttacggggtttttcgggtccgtttacggggtttaccggggaccggggtacccggggaaccgtaacgggttcccgg

SEQ ID NO: 401783 - DNA, 566 bp, Homo sapiens
  misc_feature: GZ8MTXP02IVDLA.21.25.C03.1.454.CMB.2.raw
  modified_base (276)..(276): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtcgcccanagctgaagcagacgccctacccaaactcctactatctagtcggtaacagcaactccggccctcgacggggtccctgaccgtattcctcgtggcctaccaagtctggcctacctcacgtccctcccgtcggtcacgtccgcgtcgggacctccgacggtcctgacgtagtgaggtactgtaatttatttacgtgacctacgtcctatacgacctaacctacccgttgtccggtttggttttggtccgttggtccgggcgggtaccggtaaccgaaggtccg

SEQ ID NO: 401784 - DNA, 707 bp, Homo sapiens
  misc_feature: GZ8MTXP02JSQKZ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtctgagtgctgcctcttgtcgcccacagctgaagcagacgccctaccaaactcctacatctaatcggtaaaccagactaaagtccggcccctacggacggggttcccctaggaacccgtactttcctccgttcgggtcctaccgtaaacgttcccgttcgggaccctacccgtaccaccgtcccccttccccgttacggtcccacgttccggtcgttcggggcccttacccggacgggtccgttaggacccggtagttacggacggtcttaggtaacttttaactttaacgtttaacccgtaacgtttacccttaagtccggtaaaaccctaaacccgtaccccgttacggttccgggtttttcggggtttttcgggaaccggtttcgggtttaccgggggcccgggggtacccggggtaaccgtaaccggtccgtttaacccgggg

SEQ ID NO: 401785 - DNA, 603 bp, Homo sapiens
  misc_feature: GZ8MTXP02IVX11.21.25.C03.1.454.CMB.2.raw
  modified_base (291)..(291): a, c, t, g, unknown or other
  modified_base (437)..(437): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccagtgctggagtattgcctgagtgctgcctcgttgtcgccccanagctagaaacgcagacgccctaccaaactcctacatctagtacggtaaccagacaacgtccggccctcggaacggggtccctagaacccgtattcctcgtcggcctaccgaagtcgtcggcctacctcacgtccctccgtgtaccncgtcgcgtcggtcctacgacgtcgtacgacgtagtagtacgtcttagttatttagttacgtacgtacgtaacttacgtaacgtacgtaaacctaaccgtaccgttacggttcggtttacgggtttcgtcgttcgggttcgggaccggtaccggtaacgtacggtcg

SEQ ID NO: 401786 - DNA, 588 bp, Homo sapiens
  misc_feature: GZ8MTXP02GWWG0.21.25.C03.1.454.CMB.2.raw
  modified_base (255)..(255): a, c, t, g, unknown or other
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtctgagtgctgcctnttgtgcccanagctgaagcagacgccctaccaaactcctacatctagtacggtaaccagcaaagtccgggcccctacgaacggggttccccctaggaacccgtatttccgtcttgggacccttaccgaaacgttccgtacggcctaaccctcgaccgtccctcccgtggtccacgttcgcgtcgggtcctcgacggtctacggaccgagtgacggtctaggtaattattagttcgacctagtaccctagtacgaaaccaacctaccgtcgtcgtttggttttgcgttcggttcggcggtacggacaacggtccg

SEQ ID NO: 401787 - DNA, 662 bp, Homo sapiens
  misc_feature: GZ8MTXP02F7666.21.25.C03.1.454.CMB.2.raw
  modified_base (256)..(256): a, c, t, g, unknown or other
  modified_base (276)..(276): a, c, t, g, unknown or other
  modified_base (287)..(287): a, c, t, g, unknown or other
  modified_base (316)..(316): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccatgctgganattgtcctgagtgctgcctnttgtcgcccangctgaagcagacgccctaccaaactcctnatctaagtggtaaccagcaacgtccggccctcgacggggtcccctagacccgtatttccgtcgttcgggcctaccgaacgtctcggccaccctcacgtcccctcccgttgtccacgttccgcgtcgggtccctaccgacgggtccgtaggaccggtagttcgggaacggtcgttaaggtactttttaagtttacgttcgggtacccttaacggttaccccttaagtaaccgtaaacccgtaaacccgtaccccgttcgggttaccgggttttcggggttttttcggtccggtttcgggtttccgggggaccggggtaccggggtaaacccgtaaacgggttcccgg

SEQ ID NO: 401788 - DNA, 652 bp, Homo sapiens
  misc_feature: GZ8MTXP02JMJNI.21.25.C03.1.454.CMB.2.raw
  modified_base (288)..(288): a, c, t, g, unknown or other
  modified_base (335)..(335): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggatagtgaggaggagaggagaccaggccagtgctggagattgtcctgagtgctgcctcttgtcgccccanagctagaagcagacgccctacaaactcctacatactatggtaaaccngacaatccggccctgacggggtccctgaccgtattccgtcgtcggtcctacccgaaacgttccttcggaccctaccctacgtaaccgtcccccttcccccgttgggtaccctaagttccccggtccggttcgggggccccttacccggtacgggtaccgttacgggaaacccggtagtacggaacgggtcgttagtaacgttttaagtttaacgttcgaccctacggttacctagtacggaaacctaaccgtacccgtggttccggtttaggttttcgcggttcggttacgggcgggtacggtaccgtacgtaccgg

SEQ ID NO: 401789 - DNA, 537 bp, Homo sapiens
  misc_feature: GZ8MTXP02JNTNQ.21.25.C03.1.454.CMB.2.raw
  modified_base (273)..(273): a, c, t, g, unknown or other
  modified_base (277)..(277): a, c, t, g, unknown or other
  modified_base (283)..(283): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccatgctggagattgcctgagtgctgcctntgcnccccangctgaagcagacgcctaccaaactcctcatctagtggtaacccagaccaagtccggccctcgacggggtcccctagaccgtacttcctcgtcggcctaccgtagtctcggccaccctcacgtccctccgtggtcattcgcgttcgggcctaccgaggtccgtgaccgattggacgtctgtattactattcgcctacgtctatcgacaactcctgtcgtttggtttggcgttcggtcggtcggacggacagtccg

SEQ ID NO: 401790 - DNA, 579 bp, Homo sapiens
  misc_feature: GZ8MTXP02JZ3QF.21.25.C03.1.454.CMB.2.raw
  modified_base (255)..(255): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtcctgagtgctgcctcttgtgcccanagctagaacgcagacgcctaccaaactcctcatctatcggtaaccagcaagtccggccctcgacggggttcccctagacccgtatttccgctcgggcctaccgaaagtcctacggccacctcacgtccctcccgtggtccacgtccgtcgtcgggctcccgaggcctagacgtagtgacggctagtatttagttattcgacctacggttaccctagtacgaaacaaccgtaccctggtcggtttcggttttcggccgtttcggttccgggccgggtaccggtacgaacgtccgg

SEQ ID NO: 401791 - DNA, 550 bp, Homo sapiens
  misc_feature: GZ8MTXP02GFPNL.21.25.C03.1.454.CMB.2.raw
  modified_base (276)..(276): a, c, t, g, unknown or other
  modified_base (287)..(287): a, c, t, g, unknown or other
  modified_base (295)..(295): a, c, t, g, unknown or other
  modified_base (301)..(301): a, c, t, g, unknown or other
  modified_base (350)..(350): a, c, t, g, unknown or other
  modified_base (360)..(360): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagtattgtcctgagtgctgcctnttgtcgcccanagctgaancagacncctaccaaactctcatctaatgaaccagcaatccgcctcgacgggtccngacctattcnctgcctacagtctgcactcacgtccctcctgcatcgcgtcggcctccgaggtctgaacggtgtacggaggtcttagtatttaattagttcgccgtaagttccctaatacggtaaaccaacctacccgttgtaccggtttggtttcggtcgtttcgggttcggggcccggtacggaaccgtaacggtccgg

SEQ ID NO: 401792 - DNA, 543 bp, Homo sapiens
  misc_feature: GZ8MTXP02FQ2U7.21.25.C03.1.454.CMB.2.raw
  modified_base (277)..(277): a, c, t, g, unknown or other
  modified_base (287)..(287): a, c, t, g, unknown or other
  modified_base (360)..(360): a, c, t, g, unknown or other
  modified_base (412)..(412): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgagggaggagaggagaccaggccagtgctggagattgtcctgagtgctgcctnttgtgcccanagctgaagcagacgccctaccaaactcctacatctatacggtaaccagcaatccggccctcgacggggtcccngacctattcctctggcctaccaagtctcggcacctcacgccctcccgtgtcntcgctgggcctcgaggctgacgatcgaggtctagtatttagttattcgacctacgtctatacgaaccaaacctacccgtcgtcgtttggttttcggtcgttcggttcgggcgggtcggtaccgaacgtccg

SEQ ID NO: 401793 - DNA, 682 bp, Homo sapiens
  misc_feature: GZ8MTXP02HSEBD.21.25.C03.1.454.CMB.2.raw
  modified_base (284)..(284): a, c, t, g, unknown or other
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtggaggaggagaggagaccgaggccatgcgtggagtattgtcctgagtgctgcctcttgngcccanagctgaagcagcgcctccaaactcctcatctagtacggtaaccagactaactccggcctcggacgggtccctacgaccgtattcctcgtcggtcctacccgtaacgtcgtacggcctacccgtcgaccgtcccgtcccgttacggtacccgtacgtccgccgttccggggtcccgttacccgacgggtcgttcgggaaaccggtagtacggtacgggtaccgttaggttacgttttaatttacgttacgtaccccgttaacggttaccctttaaacgtaacggtaaaccctaaacccgttacccgttacggttcggttttcggggtttttccggtccgtttcggggtttcccggggaccggggtacccgggtacccggtaaacggttcccgg

SEQ ID NO: 401794 - DNA, 566 bp, Homo sapiens
  misc_feature: GZ8MTXP02J0RDQ.21.25.C03.1.454.CMB.2.raw
  modified_base (275)..(275): a, c, t, g, unknown or other
  modified_base (286)..(286): a, c, t, g, unknown or other
  modified_base (314)..(314): a, c, t, g, unknown or other
  modified_base (361)..(361): a, c, t, g, unknown or other
  modified_base (369)..(369): a, c, t, g, unknown or other
  modified_base (452)..(452): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtctgagtgctgcctnttgtcgcccanagctgaagcaagcgcccaccaaactccncatctagtaggtaaccagcaacgtccggccctcggacggggtccccngacccgtnttcgtcgtggcctaccaagtcgtcggccacctcacgccctcccgtggtcactccgcgtcgggcctccgacggctgacgagtgnggtactggttattactttagtcgtacctacgttacctaagtcgaaacctaacctcccgtcggtcggttttggtttcggtcgttcggttccgggccggtacgggaccgacgtccg

SEQ ID NO: 401795 - DNA, 671 bp, Homo sapiens
  misc_feature: GZ8MTXP02I8AKI.21.25.C03.1.454.CMB.2.raw
  modified_base (211)..(211): a, c, t, g, unknown or other
  modified_base (292)..(292): a, c, t, g, unknown or other
  modified_base (302)..(302): a, c, t, g, unknown or other
  modified_base (325)..(325): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccccgtggggccccagaccaccggagggcggctgcgtcagcacagactgggcccaggaccctgngcagtgagcgaggagagtgaggaggagaggagaccaggccagtgctggagtattgcctggagtgctgcctgttgcgcccanaggctagaancagcgcctacccaaacctcctanacttctaagttacggaaacacgacctaaacgtcccccggtccgttaaccggccggggttacccctacgtaacccggttactttccgtaccgttcgggaccctaccgtaaacgttccgtaccggaccctcccgtaccgtacccgtcccttccccggtggtcctacgtccgcgttcggggcccttccggacgggtcgtacggaaccggtgtggacggtcttaaggttacttagtttaacgtactacgttacctacgtaacgtaccctaaaccgtcccggttagttccggtttggggttttcgccgtttcgggttaccggccggggtaccgtacgacggtcttaccggg

SEQ ID NO: 401796 - DNA, 598 bp, Homo sapiens
  misc_feature: GZ8MTXP02I1RWP.21.25.C03.1.454.CMB.2.raw
  modified_base (290)..(290): a, c, t, g, unknown or other
  modified_base (390)..(390): a, c, t, g, unknown or other
  modified_base (468)..(468): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagtattgtcctgagtgctgcctcgttgtcgccccanagctagaacgcagacgccctaccaaactcctacatcctaatcggtaaccagcaaacgtccggccccttcggacggggttcccctagacccgtatttcccncgtcggcctcaagtcgtcggccacctcacgtccctccctgtcactcgcgttcgggcctccgaggtcctgtacggacgnggtacgcgtagttaactttatttagttcgcctaacgttccgtaatacgaaacctaaacctccgttcggttccggtttggttttcggcgtttacggttccgggacgggtaccggtaccgtaacggtcccgg

SEQ ID NO: 401797 - DNA, 411 bp, Homo sapiens
  misc_feature: GZ8MTXP02ILF21.21.25.C03.1.454.CMB.2.raw
  modified_base (372)..(372): a, c, t, g, unknown or other
  modified_base (407)..(411): a, c, t, g, unknown or other
tcagtcgtcgctcgcacgaccggtgctcgatttagtagtgtagatttgggtttgggagcagctccaacatcgggtcaccttttgatgtgcactggtatcagcaacttccaggaaccagcccccaaactcctcatctatggtaacagcaatcggccctcaggggtccctgaccgattctctggctccaagtctggcacctcagcctccctggtcatcgctgggcctccaggctgacgatgaggctgattattattgccagtcctatgacaacacctgcgttggttttggctgttcggcggcgggaccagctgaccgtctaggtcagcccaaggctcgcccctcggtccactctcgttccccaccctcctccgngcgacgacgtgacgcgggctgggcaggcgcatagnnnnn

SEQ ID NO: 401798 - DNA, 602 bp, Homo sapiens
  misc_feature: GZ8MTXP02G3EES.21.25.C03.1.454.CMB.2.raw
  modified_base (278)..(278): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgctggagtattgtcctgagtgctgcctntgtcgcccangctagaagcagacgcctaccaaactcctacatctagtaggtaaaccagacaagtccggccctacgacggggtcccagaccgtattcctacgtcggacctaccgaacgtcgtcggacctaccctacaccgtccctcccgtaggtcacgtccgcgtcggcctccgacggtctacggaacgagtacggacgtcgttagtactttagttacgttcgacctacgtacctaagtacgaaaccctaaccgtaccgttcggtcggtttagggtttcggtcgttcggggtaccggccgggtaccggaacccgtacggtcccgg

SEQ ID NO: 401799 - DNA, 675 bp, Homo sapiens
  misc_feature: GZ8MTXP02FHWVL.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagacgcctaccaaactcctcatctatggtaaccagcaagtcggccctcgacggggtccctgaccgtattcctctggctccaagtctcggcaccctcacgtccctccctggtcacgtccgcgtcggggtccctaccgacgggtccgtcggaaccggtaagttcggaacgggtccttaggttaactttaacgtttaagtttccggacccgttaacggtttacccccgttaaagttacccggaaaccctaaaaaccccgtacccccgtttacgggttacccgggtttttacggggttttttaaccggggtccggttttaccgggggtttacccgggggtcccgggggtacccgggggtaaacccccgaaacgggttcccccggg

SEQ ID NO: 401800 - DNA, 672 bp, Homo sapiens
  misc_feature: GZ8MTXP02H8OEA.21.25.C03.1.454.CMB.2.raw
  modified_base (285)..(285): a, c, t, g, unknown or other
  modified_base (297)..(297): a, c, t, g, unknown or other
  modified_base (311)..(311): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtcgcccangctgaagcagcncctaccaaactccnatctataggtaaccagacaacgtccggccctcggacggggttcccctagggaccctatttcctcgtcggccttacccgaacgttccgtacggccctaccctccgaccgtccccttcccgtcggtaccacgtccgtccgtcggggtcccttccggacgggtctacgggaaccggtagtacgggtaacggtccgttaggttaattttaacgtttacgtttaccggacccttaacggttacccttagtaaccgtaaacctaaaccccgttacccgttcgggttccggttttcggggtttttcgggtccgttcgggggtttacccggggccggggtacccggggtaacccgtaacggtccccggg

SEQ ID NO: 401801 - DNA, 605 bp, Homo sapiens
  misc_feature: GZ8MTXP02IOZV0.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtggaggaggagaggagacaggccagtgcgtggagattgtcctgagtgctcgccttcgttgtcgcccacagctagaagcagacgccctacccaaacctcctacatactagtagtaacccagacctaacgtccggcccgtacggaccgggtccctcgaccgtacttccgtcgtcggcctaccgaacgtccgtcgccctacctcgaccgtccctccgtcggtccacgtccgtcgtccgggtccctccggacggtcgtacggacgtagtcggacggtcttagtatttagttagtcgcctactcctatacgaaacctaccgtaccgttcggttcggtttggtttcggtcgttcgggttcgggccgggtaccggaccgtacgtccgg

SEQ ID NO: 401802 - DNA, 681 bp, Homo sapiens
  misc_feature: GZ8MTXP02FVWAX.21.25.C03.1.454.CMB.2.raw
  modified_base (284)..(284): a, c, t, g, unknown or other
  modified_base (314)..(314): a, c, t, g, unknown or other
  modified_base (329)..(329): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctgggccccagacaccgagggcggctgcgtcagcacagactgggcccaggaccctgtgcagtgagcgaggagagtgaggaggagaggagaccaggccatgctggagattgtcctgagtgctgcctgttgcgcccangctgaagcagacgccctaccaaactcctanatctataggtaaccngacaatccggccctacgacggggtccctgaccgtattcctcgttcggccttacctaacgtcgttcggaccctaaccgtccaccgtccccttcccgtggtacctagtccggccgttcgggggcccttccgaacgggtccgttacggaaccggtagtaccggtagggtccgttacgggttaacttttagttaacgtttccgggtaccctaacggtttcccttaaacgtacggtaaaccccaaacccgttacccgttcggtacccgggtttttaggggtttttccgggtccggtttacggggtttcccgggggaccggggtttaccgggggtaaacccacggggtttaaccccgg

SEQ ID NO: 401803 - DNA, 578 bp, Homo sapiens
  misc_feature: GZ8MTXP02FIL0R.21.25.C03.1.454.CMB.2.raw
  modified_base (255)..(255): a, c, t, g, unknown or other
  modified_base (275)..(275): a, c, t, g, unknown or other
  modified_base (285)..(285): a, c, t, g, unknown or other
  modified_base (358)..(358): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtcctgagtgctgcctnttgcgcccanagctagaagcagcgcctaccaaactcctacatctagtggtaaccagacaagtccggcctcgacggggttcccngaccgtattcctcgtcggcctacgtaacgtcgtcggcctacctcaccgtccctcccgtggtccacgtccgtcgtcggggcctaccggaggtctaggaaccgtagtcggaacggtcttaggttaatttattacgttcggaccctacgtcctatacgaaacctacctacccgttggtcgttttggtttcggcgttcggttccgggcggacggaccaggtccg

SEQ ID NO: 401804 - DNA, 631 bp, Homo sapiens
  misc_feature: GZ8MTXP02I3XDC.21.25.C03.1.454.CMB.2.raw
  modified_base (277)..(277): a, c, t, g, unknown or other
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccatgctggagattgtcctgagtgctgcctnttgtcgccccangctgaagcagacgccctaccaaactcctacattctaagtcggtaaaccagaccaaacgtccggccctacggacggggtcccctaggacccgtattccgtcgtcggtacctcccgtaaagtcctcggccctacctccgaccgtccccttccccgtggtccacgtccgcgtcggcctaccgaggtccgtacgacgagtaggaacggtctagtatttacgttagttccggacttacggtccttaaagtaccgaaaccgtaaacccgtcccgttcggtcggttttcgggttttcggcgtttcgggttcccggggaccggggtaccgggtaaccgtaacggtcccgg

SEQ ID NO: 401805 - DNA, 696 bp, Homo sapiens
  misc_feature: GZ8MTXP02IRVLB.21.25.C03.1.454.CMB.2.raw
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctnttgtcgcccangctagaacgcagacgccctacccaaactcctacattacctatacgggtaaaccaggacctaaacgttcccggccccttcggaaccgggggttcccccttagggaaccccgttatttcccgtaccgttcgggtcccttacccgtaaacgttccgtcggcctaacccttcgaccggtccctcccgttggtcctacgtccgtcgtcggggtccctaccgtacgggtccgttcggaaccgtagtacgggtaacggcgtttaggttaaactttagtttaacgttcgtacccgttacggtttaccttagtacgtaaacctaaacccgtaccccgttggttaccggttttggggtttttcggtccggtttcgggtttaccggggccggggtaccggggaacccgtaacggttcccgg

SEQ ID NO: 401806 - DNA, 631 bp, Homo sapiens
  misc_feature: GZ8MTXP02IPXP3.21.25.C03.1.454.CMB.2.raw
  modified_base (275)..(275): a, c, t, g, unknown or other
  modified_base (283)..(283): a, c, t, g, unknown or other
  modified_base (290)..(290): a, c, t, g, unknown or other
  modified_base (326)..(326): a, c, t, g, unknown or other
  modified_base (364)..(364): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagacaggccatgctggagtatgtcctgagtgctgcctntgcgccangctgaancagacgccctacaaactcctacatctatggtaaccngcaagtccgccctcgacgggtccctagaccgtattccncgtggcctacaagtcgtcgccactccacgtccctcccgtggtcctacgtcgcgttcgggccttaccgacgggtcctacggacgtacgtcggtacggtacgttaggtaactttagtttaacgttccgtacccttaacgttacccgttaacgtacggtaaaacccctaaccgttaccccgttacgggttaccgtttttcgggtttttcggccggttttccggggttccgggtacccggggtaccgggtaacccgtaaacggtttcccgg

SEQ ID NO: 401807 - DNA, 568 bp, Homo sapiens
  misc_feature: GZ8MTXP02HAW5A.21.25.C03.1.454.CMB.2.raw
  modified_base (293)..(293): a, c, t, g, unknown or other
  modified_base (408)..(408): a, c, t, g, unknown or other
  modified_base (443)..(443): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagtattgtcctgagtgctgcccttcttgtcgccccangctgaagcagacgcctaccaaactcctacatctaatggtaaaccagacaacgtccggccctacggacggggtccctgaccgtattcctcgtgcctaccacgtctcggccacctcncgccctcctcggtcacgtcgcgtcgggcctaccgnggtctgacgtagtgagtctagtatttattatcgctacgtcctatcgaacctaaccgtcccgtaggttccgtttgggttttcggcgtttcgggttccgggcgggtacccggtacgtaacggtcccg

SEQ ID NO: 401808 - DNA, 724 bp, Homo sapiens
  misc_feature: GZ8MTXP02H5LFQ.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagtgaggaggagaggagacgagccatgctggagtatcgctgagtgctgcctgttgtcgccccacgagctagaacgcagacgaccctaccaaaaccttccacattacctagtacggtaaacccagacaacgtccggccctcggaccggggtccctacgaccgtacttcctacgtcgggcttacccgaaacgttccgtaggccctaacccgtccgacccgtccccttccccgtcgggttaccctacgttccggtccggtcggggtcccttacccggacgggtccgttacggaccggtacgttagggaaacggggtccttaggtaattttaacgtttacgttacggtaacccttacggttacctttacgtaaccgaaaaccctaaacccgtaacccccggtttacggttcccgggtttttggggtttttccgggtaccgtttccggggtttacccgggggcccgggggtaaccccgggggttaacccgaaaacgggtttcccccggg

SEQ ID NO: 401809 - DNA, 609 bp, Homo sapiens
  misc_feature: GZ8MTXP02JPPAN.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgcctgagtgctgccttgttgtcgcccanagctagaacgcagacgcctacccaaactcctacactctaagtacggtaaaccagacctaaacgtcccgggacccctacggaccggggttccccctacggaccgtacttccgtcgtacggtcctacgtaacgtcgtcggacctacctcaccgtccctcccgtggtccacgtcgcgtcgggctaccgaggtcctagacgtgtgagtactgtaatttattacgtcgtacctacgttacctatacgaacctaaccgtcccgttacggttccggtttaggtttcggcgttcgggttccgggacgggtaccggtaccgaacgtcccgg

SEQ ID NO: 401810 - DNA, 584 bp, Homo sapiens
  misc_feature: GZ8MTXP02JTWX9.21.25.C03.1.454.CMB.2.raw
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagattgtcctgagtgctgccttctgtcgcccanagctagaagcagacgccctaccaaactcctacatctagtaggtaaccagacaacgtcccggaccctcggaacggggtccccctaggaccccgtatttccgtcgttcgggcctacccgtaaacgtccgtcggcctaccctcgaccgtccccttcccgtacggtcctacgtccgcgtcggggtcctccgacggtcgtacggacgagtacggagggcttagtatttagttatcgcctacgtcctatacgacacgtacctcgtcgttggtttcgcgttcggtcggcggcggacgagtccg

SEQ ID NO: 401811 - DNA, 516 bp, Homo sapiens
  misc_feature: GZ8MTXP02H4TRJ.21.25.C03.1.454.CMB.2.raw
  modified_base (185)..(185): a, c, t, g, unknown or other
  modified_base (232)..(232): a, c, t, g, unknown or other
  modified_base (266)..(266): a, c, t, g, unknown or other
  modified_base (270)..(270): a, c, t, g, unknown or other
  modified_base (274)..(274): a, c, t, g, unknown or other
  modified_base (279)..(279): a, c, t, g, unknown or other
  modified_base (367)..(367): a, c, t, g, unknown or other
  modified_base (436)..(436): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcanagactggcccaggaccctgtgcagtgagcgagagagtgaggaggagnggagacaggccatgctggagattgcctgagtgcngctnttgngccanagctagaagcagagccctacaaaacctcctacaatctataggtaacccagacaaatccggccctacgacggggttcccagacgattcntggctcaagtctggcacctcacgtccctccctgtcatcgctcgggctccgaggtctgacagtgaaggtntagtattattatcgactacgtactatacaacaacctaccgtgtcgttggtttgcgtcggtcggcggacggaacgtacgcg

SEQ ID NO: 401812 - DNA, 616 bp, Homo sapiens
  misc_feature: GZ8MTXP02I7222.21.25.C03.1.454.CMB.2.raw
  modified_base (276)..(276): a, c, t, g, unknown or other
  modified_base (287)..(287): a, c, t, g, unknown or other
  modified_base (364)..(364): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgcctnttgtgccccangctgaagcagacgcctaccaaactcctacatctatgtaaccagcaatccggcctcgacgggtccctgaccgtattcncgtggcctacctaagtctggcctacctcgacgtccctccctggtccagtccgcgtcgggcctccgaggtctacggacgtagtcggaggtcctaggtactttagttacgttacggtaccgtaacggtttccctaatacggtaaaccctaaaccgtacccccgttagggttccggttttggggtttttcgggtcgtttacggggtttccggggacccgggggttacccggggaaaccgtaacggtttccccggg

SEQ ID NO: 401813 - DNA, 528 bp, Homo sapiens
  misc_feature: GZ8MTXP02JH3Q8.21.25.C03.1.454.CMB.2.raw
  modified_base (286)..(286): a, c, t, g, unknown or other
  modified_base (328)..(328): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtcgcccacngctgaagcagacgcctaccaaactcctcatctatggtaaccngcaatccggcctcgacggggtccctgacccgtattccgtctggctccaagtctcggcacctcacgtccctccctcggtcactcgcgtgggcctccgacggctgacgagtcgaggctgtattattacttcgcctacgtcctatacgacaactaccctgtcgttggtttcgcgttcggttcgggcggtacggaccaggtccg

SEQ ID NO: 401814 - DNA, 613 bp, Homo sapiens
  misc_feature: GZ8MTXP02HQG4W.21.25.C03.1.454.CMB.2.raw
  modified_base (273)..(273): a, c, t, g, unknown or other
  modified_base (281)..(281): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgactgtctgccctggggccccagacaccggagggcggctgcgtcagcacagactgggcccaggaccctgtgcagtgagcgaggagagtgaggaggagaggagaccaggccatgctggagatgtctgagtgctgcctntgcgccangctgaagcagacgcctaccaaactccactatctaatcggtaaacagcaacgtcgccccctgacgggggtccccctaggacccgtacttctcgtcgaccctaccgtaaacgttcctggcccaccgtcaccgtccctcccgtacggttcacgtcgtccgttcggccttacccgagggtccctaggaccgtagtaccgggacgtacgttacgttaatttagtttacgtccgtaccgttacgttacctacgtaccgtaaacctaccgttaccgtttcggttcggtttcggtttacggtccgttacgggtaccgggaccggtaccgggaacgtaacg

SEQ ID NO: 401815 - DNA, 663 bp, Homo sapiens
  misc_feature: GZ8MTXP02I2JV7.21.25.C03.1.454.CMB.2.raw
  modified_base (224)..(224): a, c, t, g, unknown or other
  modified_base (294)..(294): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactgggcccaggaccctgtgcagtgagcgaggagngtgaggaggagagagaccaggccagtgcgtggagtattgtcctgagtgctgccctgttcgtcgcccacgngcagagcagacgaccctaccaaactcctactattactagtacgtaaccacgtacctaacgtcccgtcccgtaccggtaccgggtccctacggtaccgttacttccgtcgtccgtaccttaccgtaacgttccgtaccggaccctacccgtaccgcccgttccccgtcccggtcgtacccgtcgtccgtcggtaccggtcccgtaccggtacggtccgtacggacgtagtggtacgtgttagttacgtttagttacgtacgtaccgttacgtacctacgtaccgaacctaacccgtccgttacggttcgggtttcggtttcggtcggttccgggttaccggggaccggtaccgggtaaccgtacggtccg

SEQ ID NO: 401816 - DNA, 604 bp, Homo sapiens
  misc_feature: GZ8MTXP02FI5SH.21.25.C03.1.454.CMB.2.raw
  modified_base (257)..(257): a, c, t, g, unknown or other
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgctgganattgtcctgagtgctgccttcgttgtcgcccanagctaggaagcaagacgcctaccaaacctcctacatctaagtacggtaaccagacaaacgtccggccctcgacggggtccctcgacccgtattcctcgtcggctaccgaaagtctcggccaccgtcacgtccctcccgtcggtacacgtccgtcgtcgggcctaccgaggcgtagacgtaagtcgacggtcttagtatttagttacgttacgacccttacgtacctagttacgaaacctaaccgtacccgtcgtcggttttggttttcggcgtttcgggttccgggaccggggtaccggtaaccgacgtacccg

SEQ ID NO: 401817 - DNA, 594 bp, Homo sapiens
  misc_feature: GZ8MTXP02GHNSC.21.25.C03.1.454.CMB.2.raw
  modified_base (276)..(276): a, c, t, g, unknown or other
  modified_base (282)..(282): a, c, t, g, unknown or other
  modified_base (287)..(287): a, c, t, g, unknown or other
  modified_base (359)..(359): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcncccangctgaagcagacgccctaccaaactcctacatctaatggtaaccagcaagtccggccctcgacggggtcccngacccgtattcctcgtgctaccaagtctcggcacctcacgtccctcccgtgtcacgtcgcgtcgggcctccgacggtctacggacgtacgtcggacggtcttagtaactttaagtttaacgttcgaccctacggttccctaaagtacgtaaacctaaccctacccgttcggtccggttttggttttcggcgtttcgggttccggggccgggtaccgggtaccgtaacggtcccgg

SEQ ID NO: 401818 - DNA, 500 bp, Homo sapiens
  misc_feature: GZ8MTXP02GVH6D.21.25.C03.1.454.CMB.2.raw
  modified_base (274)..(274): a, c, t, g, unknown or other
  modified_base (277)..(277): a, c, t, g, unknown or other
  modified_base (283)..(283): a, c, t, g, unknown or other
  modified_base (290)..(290): a, c, t, g, unknown or other
  modified_base (294)..(294): a, c, t, g, unknown or other
  modified_base (310)..(310): a, c, t, g, unknown or other
  modified_base (324)..(324): a, c, t, g, unknown or other
  modified_base (419)..(419): a, c, t, g, unknown or other
  modified_base (421)..(421): a, c, t, g, unknown or other
  modified_base (424)..(424): a, c, t, g, unknown or other
  modified_base (448)..(448): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgcctgagtgctgcctntgngcccangctgaancagngcctaccaaactcctnatctatagtaaccngcaatccggcctcgaggggtccctgaccattcctgtgcctcaagtctggcacgtcacgcctccgtgtcatcgctggcctccgaggctgacggtangngtntagtattatagtcgctacgtctanacaaccacctcgtcgtcgttgttcgtcgttcggtcggcggtacgacacgtcg

SEQ ID NO: 401819 - DNA, 573 bp, Homo sapiens
  misc_feature: GZ8MTXP02FO0SW.21.25.C03.1.454.CMB.2.raw
  modified_base (276)..(276): a, c, t, g, unknown or other
  modified_base (286)..(286): a, c, t, g, unknown or other
  modified_base (365)..(365): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagtattgtctgagtgctgcctnttgcgcccanagctagaagcagacgccctaccaaactcctacatctaagtacgaaccagacaacgtccggccctacggacggggtcccngaccgtattccgtcgtggcctactagtctacgccacctcgacgtccctacccgtgtactcgtcgcgtcggcctcgacggctagacgagtacggcggtatgttaattcttaatcgacctagttaccctagtacgaaacctaaccgtaccgttcggtcggtttggtttcgcggtttacggtcggggtaccggtacggaaccgacggtccg

SEQ ID NO: 401820 - DNA, 658 bp, Homo sapiens
  misc_feature: GZ8MTXP02H7G1Y.21.25.C03.1.454.CMB.2.raw
  modified_base (261)..(261): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtcgggcccaggaccctggtgcagtgagcggaggagagtggaggaggagaggagacgaggccatgctggagnttgcctgagtgctgtcctctgtccgccacagctggaacgcgagacgtcccctaccaaaacctccacaatttccgtaaagtacggtaacccacgtaccctaaacggtcccccggtacccgttaccggaccggggttcccctacggtaacccgttactttccgtcccgtcgggacccttacccgaaaccgttccgcggacctacccgtccacgtccccgtcccgtcggtcacgtccgcgtcggcccttccgacggtcgtacggacgtacgtggacggtcgttagtatttagttagtcgtaccgtagtaccctttagactaaactaaccgttaccgtcggttcgtttggttttcggtcgttcgggtaccgggacgggtaccggtaaccgtaacgtcccgg

SEQ ID NO: 401821 - DNA, 606 bp, Homo sapiens
  misc_feature: GZ8MTXP02FOM5R.21.25.C03.1.454.CMB.2.raw
  modified_base (286)..(286): a, c, t, g, unknown or other
  modified_base (330)..(330): a, c, t, g, unknown or other
  modified_base (357)..(357): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgccctaccaaactcctcatctatggtaaccngcaagtccggccctcgacggggtcccngaccgtattctctggcctaccaagtctcggccacctcacgtccctcccgtggtccagttcgcgtcgggcctccgaggtctggacgtagtggacggtctaggtaactttagttaacgttcggaccctacggttaccctataccgaaaccctaaacccgtaccccgttggttccggttttcggggtttttcgggtccgtttacggggttacccgggggtccggggtaccggggtaaaccgtacggtcccgg

SEQ ID NO: 401822 - DNA, 785 bp, Homo sapiens
  misc_feature: GZ8MTXP02FQP71.21.25.C03.1.454.CMB.2.raw
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtctgagtgctgcctnttgtgcccanagctgaagcagagcctaccaaactcctacatctatggtaaccagcaatccggccctcacgtcggggtcccctggaacccgtatttcctacgtcgggtcccttacccgtaaacggttcccgttacggggccctaaaccccgttcccgtaacccggtccccccgtttacccccgttcggggttccctaaacgttcccgggtcccggttaccggggggtacccctttcccccgggaacggggtccccgttacgggggaaacccggtaacggtttacggggaacgggtacccgtttaagggttaaccttttaagttttaaacgtttccgggtaccccttaacggttacccccgttaaagtttaccgggaaaaccctaaaaccccgttaacccccgttacgggtttacccggttttaacgggggtttttttcggggtaaccggttttcgggggtttacccgggggacccgggggtaccccgggggtaaaccccgttaaacccgggg

SEQ ID NO: 401823 - DNA, 623 bp, Homo sapiens
  misc_feature: GZ8MTXP02HRS6Q.21.25.C03.1.454.CMB.2.raw
  modified_base (250)..(250): a, c, t, g, unknown or other
  modified_base (255)..(255): a, c, t, g, unknown or other
  modified_base (271)..(271): a, c, t, g, unknown or other
  modified_base (392)..(392): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagacaggcatgcnggagntgctgagtgctgcctntgtcgaccccagagctagaagcgtaggacgccctacccaaaactcctacaatcctaagtacggtaaaccacgtaccaaacgtcccggtccctacggacggggtccccctaggaacccgttnttcctcgtcgtacctaccgtaacgtcgcgcctacctccaccgtccccttccgtcgtactacgtccgcgtcgggcctacgacggtcgtacggacgagtcggacggtactagtaactttagttacgtcgtacctacgtacctagtacaaacctaaccgtaccgtacggttcggtttcgggttttcggtccggttcgggttccggggaccgggtaccgggtaacgtacggtccg

SEQ ID NO: 401824 - DNA, 539 bp, Homo sapiens
  misc_feature: GZ8MTXP02IHISF.21.25.C03.1.454.CMB.2.raw
  modified_base (226)..(226): a, c, t, g, unknown or other
  modified_base (278)..(278): a, c, t, g, unknown or other
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccagggaccctgtgcagtgagcgaggagagngttaggaggagaggagacaggccatgctggagattgtcctgagtgctgcctnttgtcgccacngctgaagcagacgcctaccaaactcctcatctatggtaaccagcaatcggccctcgacgggtcctgaccgattctctggctcaagtctggccactcacgtccctccctcggtcactcgcgtcgggcctccgaggtctagacgagtgaggctgtatttattattcgcctacgtactagtacgaaccaaccgtacctcggttcggtttggttttcggtcgttcggttcggcggtccgggtaccaacggtccg

SEQ ID NO: 401825 - DNA, 642 bp, Homo sapiens
  misc_feature: GZ8MTXP02FOU55.21.25.C03.1.454.CMB.2.raw
  modified_base (228)..(228): a, c, t, g, unknown or other
  modified_base (296)..(296): a, c, t, g, unknown or other
  modified_base (392)..(392): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagactgggcccaggaccctgtgcagtgagcgaggagaggngagggaggagaggacgaccaggccatgcgtggagtattgtctggagtgctcgccttgttcgcgcccanagctgaagcagacgccctaccaaactcctacatctaagtacggtaaccacgtacaacgtcccgcccgtacggtacgggtccctagaccgtattccncgtcgcctacgagtctcgacctactcgaccgtccctcccgtgtacacgtccgcggtcggcctaccggacgtcgtacgacggtagtcggagtacgttagttaagtttaacttacgttcgaaccctacggttacccttaacgtaaccggaaacccttaaaccgtaccccgtttgggttaccggtttttcggggtttcggccggtttcggggttaccggggccgggtaaccgggtaccccgtaagtaccccgg

SEQ ID NO: 401826 - DNA, 661 bp, Homo sapiens
  misc_feature: GZ8MTXP02HIN57.21.25.C03.1.454.CMB.2.raw
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtcctgagtgctgcctcttgtcgcccacgngctagaagcagacgcctacccaaactcctacattctagtaggtaaaccacgacaacgtccggccctcgaacggggttcccctagggaacccgtatttccgtcgtacgggtcctacccgtaaacgttccgtacggacctaacccttcgaccgtccccttccccgtcgggtctaacgtccgtcgttcggggaccttccggaacggtccgtaggaccgtaagtcggtaacggtctacggtaactttagttaagtttcgacccgttacggtacccttagttaccgaaaccaaaccgttaccccgtaggttccggtttgggtttttcggcgtttcgggtttccggggacgggtacccgggttaccgaacggtcccgg

SEQ ID NO: 401827 - DNA, 583 bp, Homo sapiens
  misc_feature: GZ8MTXP02JL3MU.21.25.C03.1.454.CMB.2.raw
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctntgtcgcccanagctgaagcagacgccctaccaaactcctacaatcctaatggtaaacccagcctaaagtccggccctacgacggggtccctagacccgtattccgtctcggctacccgaaagtcgtcggccacctcacgccctcccgtggtacactccgcgtcgggcctccgacggtcgtagaccgtagtcgacggcgttagtactttattatcgacgtacgtcctagtacgaacctaacctacccgtcgtccggtttggtttcggtcgttcgggttccgggtcgggaccgggtaccgaacggtcccgg

SEQ ID NO: 401828 - DNA, 548 bp, Homo sapiens
  misc_feature: GZ8MTXP02JAWFI.21.25.C03.1.454.CMB.2.raw
  modified_base (256)..(256): a, c, t, g, unknown or other
  modified_base (285)..(285): a, c, t, g, unknown or other
  modified_base (293)..(293): a, c, t, g, unknown or other
  modified_base (331)..(331): a, c, t, g, unknown or other
  modified_base (491)..(491): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatgttgaccgtctgccctggggccccagacaccgagggcggctgcgtcagcacagactgggcccaggaccctgtgcagtgagcgaggagagtgagggaggagaggagaccaggccatgctgganattgcctgagtgctgcctgttgcgcccangctagaancagacgcctacccaaactcctacatctaatggtaaccngacaagtccggccctacgacgggtccctgacccgtattctcgtgcctaccagtctgccaccgtcacgccctcccgtggtcctacgtcgcgttacgggcccttacccgaggcctaggacgtaagtcgacggcttgtatttattagtcgacctagtccttancgaactactaccgtgtcgtttggttcggcttcggtcggacggtcgaaacctgtcccg

SEQ ID NO: 401829 - DNA, 566 bp, Homo sapiens
  misc_feature: GZ8MTXP02F5ZR8.21.25.C03.1.454.CMB.2.raw
  modified_base (276)..(276): a, c, t, g, unknown or other
  modified_base (287)..(287): a, c, t, g, unknown or other
  modified_base (407)..(407): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcctgagtgctgcctnttgtcgcccanagctagaagcagcgcctaccaaactcctacatctagtaggtaaccagacaacgtccggcctacgacggggtccctaggaccgtattcctcgtcggcctaccgtaagtctcggctacctcncgccctccgtgtcactcgcgtcggcctccgacggtcgtcgacgtagtgacggtctagtattattagtcgtacgtacgtactagtacgaactaacctaccgtcgtccgtttggttttcggcgttcgggttccggacgggtaccggtaccgtaacggtccg

SEQ ID NO: 401830 - DNA, 737 bp, Homo sapiens
  misc_feature: GZ8MTXP02JOTD4.21.25.C03.1.454.CMB.2.raw
  modified_base (297)..(297): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgctggagtagttgtccgtgagtcgctcgcctcgttgtcgaccccanagtctagaacgcagacgccctacctaaaacctccctactaattcctaaagtacggtaaaccacgacgtaacgtcccgggcccctacggaccggggttcccctgaacccgtatttccgtcgtcgggtacctaccctaaacgtcccgtacggccctacccgtccgtacccgtccccgttccccgtcggtaccaccgttcccgcgttaccggggccttcccggaacgggtccgtagggaaccggtaggtacgggtaacgggttccgttagggtaatttaaacgtttacgtccggtaacctaccggtttaccctaagttaccggaaaaccctaaccccgttaacccgtcgggtttcccgggtttaggggtttttccggtaccggtttaccgggggtttccgggggacccgggtacccggggtaacccgtaaacggttccccggg

SEQ ID NO: 401831 - DNA, 590 bp, Homo sapiens
  misc_feature: GZ8MTXP02JX6X9.21.25.C03.1.454.CMB.2.raw
  modified_base (275)..(275): a, c, t, g, unknown or other
  modified_base (318)..(318): a, c, t, g, unknown or other
  modified_base (359)..(359): a, c, t, g, unknown or other
  modified_base (369)..(369): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgccccagagctagaagcagacgccctaccaaactcctnatctatcggtaaccagcaatccggccctcgacggggtcccngaccgattcntcggccttaccaagtctggccctacctcacgtccctcccgtggttaccagttccgcgtcggggacccttccggacggtcctaggaccgtagtggaacgggtctaggtaatttagttaagttcgacctacggttacctaagtaccgaaacctaaacctacccgttgtccggttttgggttttcgcgttcgggtttcgggccggtacggggaccaaggtcccg

SEQ ID NO: 401832 - DNA, 564 bp, Homo sapiens
  misc_feature: GZ8MTXP02JQDJQ.21.25.C03.1.454.CMB.2.raw
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgtcgcccanagctgaagcagacgcctaccaaactcctcattctatgtaacccagacaactccggccctcgacggggtccctgacccgtattcctctcggcctaccgaagtccgttcggccaccgttccacgtcccctcccgtcggtcacgtccgcgttcgggcctccgacggtctgacgagtggagtctagtatttattatcgacctacgtctagtacgaacctactaccccgttgtcgtttcggtttcgtcgttcggttccgggcgggtaccggtaccgacgtccg

SEQ ID NO: 401833 - DNA, 516 bp, Homo sapiens
  misc_feature: GZ8MTXP02IZKE4.21.25.C03.1.454.CMB.2.raw
  modified_base (273)..(273): a, c, t, g, unknown or other
  modified_base (282)..(282): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctgggccccagacaccgaggcgctgcgtcagcacagactgggcccaggaccctgtgcagtgagcgaggagagtgaggaggagaggagaccaggccagtgcgtggagattgtcctgagtgctgcctntgtgcccanagctgaagcagacgcctaccaaactcctacattcctaatggtaacccagcaagtccggcctcgacggggtcccctgacccgtattcctcgtcggccttaccaaagtctcggaccacctcacgtccctcctggtcactcgctggctcgacgtctgacgatgacgtctgtattattgtgcctagtcctatcgaacactacctgtcgttgtttgcttgtacggcgtcggacagtccg

SEQ ID NO: 401834 - DNA, 675 bp, Homo sapiens
  misc_feature: GZ8MTXP02IFF26.21.25.C03.1.454.CMB.2.raw
  modified_base (291)..(291): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacgaggccagtgctggagtattgtcctgagtgctgccttcttgtcgaccccanagctagaacgcagacgccctaccaaaaccttccacattctagtacggtaaccagactaacgtccggccctacggacggggttcccctagaccgtattcccgtcgtcggacctaccgaagttccgacggaccctacccgtcgtacccgtccccttcccgttcggtcctacgttccgtccgtcggggtcccttcccggaggtccgttacggacggtaagtcgggtacggtacttaggttaacttttaagtttacgttccgtacccgttaacggttccttaagtacgaaaccctaaacccgttacccgttgggtttccgttttcggggtttttcggtccgtttacggggttcccggggccggaccggtaccggtaaccgtaaccggg

SEQ ID NO: 401835 - DNA, 740 bp, Homo sapiens
  misc_feature: GZ8MTXP02IWXSC.21.25.C03.1.454.CMB.2.raw
  modified_base (296)..(296): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagactgggcccaggaccctgtgcagtgagcgaggagagtggaggaggagaggagaccaggccagtgctggagtattgtcctggagtgctgtcccttgttgtccgcccangctggaagcagacgccctaccaaacttcctactaattctaagtacggtaaccagacctaaacgtcccggacccttaccggtaaccggggttcccctacgggtaacccgtacttttcccgtccgtacgggtacccttacccgtaaacggttccgtaccggaccctaaccccgtccgtaacccgtcccccgttccccgttaggttacctcgttccgtcggtccgggtcccttccggaacgggtgttaccgggacgtacgtacggaacggttcttaaggttaaacttttacgtttagttaccgacgttaacgttaccgttaaactacggaaaccctaaacccgtcccgtttacggttaccgggtttttaggggtttttccggccgggttttcggggtttacccgggggccggggtaacccggggtaaccgttaacggtttacccggg

SEQ ID NO: 401836 - DNA, 664 bp, Homo sapiens
  misc_feature: GZ8MTXP02F0B0B.21.25.C03.1.454.CMB.2.raw
  modified_base (238)..(238): a, c, t, g, unknown or other
  modified_base (292)..(292): a, c, t, g, unknown or other
  modified_base (338)..(338): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagtgaggagagtgaggaggagagganaccgaggccagtgctggagtattgtcctgagtgctgcctcttgtacgccccaangctagaagcagacgccctaccaaactcctacatctagtagtaaccngacacgtccggccctcgacggggtccctgaccgtattccgtcgtcggtacctcccgaaagttccttcgggaccctaaccgttcccgaacgtcccccgtcccgttacggttcctacgtccgtccgtcggggtccctaccggaacggtccgtacgaacggtagtaccggaggtccgttaaggtacttttaagttagtttccgaccgtacggttacccttagtaccgaaacctaaaccgtcccgttacggtccggttttacggggttttcgccggtttacgggttacccgggggccgggtaaccggggtaacccgtaacggttccccgg

SEQ ID NO: 401837 - DNA, 752 bp, Homo sapiens
  misc_feature: GZ8MTXP02G3H52.21.25.C03.1.454.CMB.2.raw
  modified_base (240)..(240): a, c, t, g, unknown or other
  modified_base (284)..(284): a, c, t, g, unknown or other
  modified_base (317)..(317): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggacctgtgcagtgagcgaggagagtgaggaggagaggagacnggcatgctggagtattgctgagtgctcgcctgttgcgaccccanacgctagaagcagacgccctaccaaactcctanattctaagttcggtaaaccagacctaaacgtcccgggtacccctacgggtaccggggttcccctacggaaccggtactttccgtacgtcgggtacccttaccgtaaagtccgtacgggaccctaccgttaccgaacccggttccccttacccccggttggttaccccgtaacgtccccgggttccggttacgggggtccccttacccgaaacgggggttcccttacgggaaacccggtagtacggggtacgtaccgttaaggttaactttagtttaaccgtcgtacccgttaacggttacccttaaagttacgaaacccgtaaaacccgttccccggtagggttccggtttttcgggggttttcggtccggtttttacgggggtccgggggtacccgggtaacccgggggttacccgaaaacggggtttccccgg

SEQ ID NO: 401838 - DNA, 583 bp, Homo sapiens
  misc_feature: GZ8MTXP02FJMBZ.21.25.C03.1.454.CMB.2.raw
  modified_base (290)..(290): a, c, t, g, unknown or other
  modified_base (320)..(320): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgccttcttgtcgccccacngctagaagcagacgccctaccaaactcctnatctataggtaaccagacaagtccggaccctcggacggggtccctacgaccgtattcctcgtcggccttaccaacgttcgtcggacctacctcgacgtccctcccgtggtccagtccgcgtcgggcctccgaggtctagacgagtcgaggtctagtagtttattagtcgaccgtacgttcctagtacaaacccaaccgtaccccgttggtccgtttggtttcggtcgttcggttccgggacgggaccggtaacgaaggtcccg

SEQ ID NO: 401839 - DNA, 543 bp, Homo sapiens
  misc_feature: GZ8MTXP02FJEGC.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagacgcctaccaaactcctacatctataggtaaaccagacaatccggccctcgacggggtccctgaccgtattcctcgtcggcctaccgaaagtcctcggccacctcacgccctcccgtgtcagtcgcgtagggcctccggacggtcgtagacgatcggaggtctagtattattagtcgactacgtcctatacgaacaccgtaccgtgtcgtttggtttcgcgttcggtcggcggtacggaccagtccg

SEQ ID NO: 401840 - DNA, 637 bp, Homo sapiens
  misc_feature: GZ8MTXP02F99JR.21.25.C03.1.454.CMB.2.raw
  modified_base (295)..(295): a, c, t, g, unknown or other
  modified_base (303)..(303): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtcgggcccaggaccctgtgcagtgagcgaggagagtggaggaggagaggagaccaggccagtgcgtggagtattgtcctggagtgctgccttgtgtcgcccangctagaancagacgccctaaccaaacttcctacatctaagtacggtaaaccagaccaaacgtccggccctacggaacggggttcccctgaacccgtattccgtcgtcggacctacctaaacgtcgtacggacccaccgtacaccgtcccctcccgtggtctacgtccgtcgtcgggccctcgacggtctaggaaccgtagtacggagtcttagtaatttagttacgtcgacctagttacccttagtaccgtaaaccaaccgtcccgttggttccggttttgggttttcggtcggtttacggggttcccgggggccggtaccgggaaccgtaacggttcccgg

SEQ ID NO: 401841 - DNA, 613 bp, Homo sapiens
  misc_feature: GZ8MTXP02JZV7Y.21.25.C03.1.454.CMB.2.raw
  modified_base (303)..(303): a, c, t, g, unknown or other
  modified_base (389)..(389): a, c, t, g, unknown or other
  modified_base (392)..(392): a, c, t, g, unknown or other
  modified_base (436)..(436): a, c, t, g, unknown or other
  modified_base (518)..(518): a, c, t, g, unknown or other
tcagtcgtcgctcgcacgaccggtgctcgatttagtagtgtagatttgggtttgggggtcgtgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagagggagaccaggcctagtgcgtggagtattcggccttggagtggctgcccttcgttgtcgaccccangctagaagcagacgtcccctacaaactccacatcgtatggtaaccagcaagtccggccctgacggggttcccagacccgtattccncgnggccttacaacgtctcgacacctcacgccctcccgtggtaaccngtcgcgtcggtcctacgacggtcgtgacggagtacgacggtacttagttaactttagttacgtcgaccgttacgttacctanaccgtaaacctaaaccgtcccgttcggtttaccggttttgggtttccggtcgttacgggttccggggaaccggtacccgggtaacgacgttcccg

SEQ ID NO: 401842 - DNA, 519 bp, Homo sapiens
  misc_feature: GZ8MTXP02JR4IR.21.25.C03.1.454.CMB.2.raw
  modified_base (279)..(279): a, c, t, g, unknown or other
  modified_base (285)..(285): a, c, t, g, unknown or other
  modified_base (450)..(450): a, c, t, g, unknown or other
tcagtcgtcgctcgcacgaccggtgctcgatttagtagtgtagatttgggtttggggctgttcctggaagttgctgataccagtgcacatcaaaagggtgacccgatgttggagctgctcccagcgcaggagatggtgaccgtctgccctggggccccagaacaccgagggcggctgcgtcagcacagactgggcccaggaccctgtgcagtgagcgaggagagtgaggaggagaggagaccaggccatgctggagattgtcctgagtgctgctcttgngcccanagctgaagcagagcctccaaactcctcatcatggtaaaccaggcaaatcggacccctgacggggtcccctggacccgatttcgctgggcctaccaaacgtctggcacctcacgccctccctggtcactcgctcggggctccaggcctgaccggatgagctgattntatgcacgtcctatcgacaacaccctcgtcgtacgttttgcttcgttcggcgtacgggacctaaggccg

SEQ ID NO: 401843 - DNA, 627 bp, Homo sapiens
  misc_feature: GZ8MTXP02ISEOJ.21.25.C03.1.454.CMB.2.raw
  modified_base (275)..(275): a, c, t, g, unknown or other
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgctggagattgcctgagtgctgcctnttgtcgccccanagctaggaagcagacgccctaccaaactccctcatcctaagtcggtaaaccagcaaacttccggcccttacgacggggtcccctgggaccctagttcctctaggcctacctaagtctacggcaacctcacgtcctccctggtcatccgctcgggccttccgacggtctacggacgtaacgtgagggtcctaggtaactttagttaagttcgtaccctaacggttcccttaaagtaccggaaaacctaaacctaacccccgttaggtcccggtttaggggtttttcggtcggtttcggtttaccggggcccggggtaccgggtaaccgtaaacggtcccgg

SEQ ID NO: 401844 - DNA, 638 bp, Homo sapiens
  misc_feature: GZ8MTXP02G00RG.21.25.C03.1.454.CMB.2.raw
  modified_base (228)..(228): a, c, t, g, unknown or other
  modified_base (277)..(277): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggccctgtgcagtgagcgaggagagtgaggnggagaggagaccaggccatgctggagtattgtcctggagtgctgccttnttgtgccccanagctagaagcagacgccctacccaaaactcctacatcctatggtaaaccagtcaaacgtccggcccctacggacggggtcccccttagacccgtattcctcgtcggctacccgtaaagtcgtacggccaacctcacgtccctcccgtggtcacgtccgcgttcggggccttccgacggtctacggacgtacgtacgggaggtaccgtaggttaactttatttaacgttcgtaccctaaacggttcccgttactaaccggtacctaaaccctacccgtcgtccgggttttcggttttcggtcgtttacggtttccggggccgggtaccggggaacccgtaacggtacccgg

SEQ ID NO: 401845 - DNA, 615 bp, Homo sapiens
  misc_feature: GZ8MTXP02JTN01.21.25.C03.1.454.CMB.2.raw
  modified_base (273)..(273): a, c, t, g, unknown or other
  modified_base (284)..(284): a, c, t, g, unknown or other
  modified_base (314)..(314): a, c, t, g, unknown or other
  modified_base (327)..(327): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctnttgtcgcccanagctgaagcagacgccctaccaaactcctnatctatgtaaacngcaatccggccctcgacggggttccctagacccgtatttcgtcgtggacccttaccgaaacgttccgtcggccctaccctccgaaccgtccccttccccgtcgggtccacgttccggccgtcggggtccctacccggacgggtccgtacggaaccggtagtcgggacggtcttaggtatttaagttagttcgacccgtacgttaccctatacgaaccaaccgtacccgtcgttcggtttggttttcggcgttcggttccggggccgggtaccgggacctaacggtccg

SEQ ID NO: 401846 - DNA, 630 bp, Homo sapiens
  misc_feature: GZ8MTXP02F6EPD.21.25.C03.1.454.CMB.2.raw
  modified_base (287)..(287): a, c, t, g, unknown or other
  modified_base (319)..(319): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccatgctggagattgtcctggagtgctgccctcttgtcgcccanaggctagaagcagacgccctacaaactcctanatctagtaggtaaccagacaagtccggccctcggacggggtccctagaccgtattcctcgtcggccttaccgaacgtcgtacggaccacctcgacgtccctcccgtggtaccacgtaccgtcgtacggggtcctaccggacggtcgtacggaacggtagtacgggaacggtcgttagtaactttagttacgttcggaccctacgttacgtactacggaaaccctaacccgtacccgtcggtcggtttcggggttttaacggtccggttcggggttaccggggaccggggtaccgggaccgtaacgtcccgg

SEQ ID NO: 401847 - DNA, 830 bp, Homo sapiens
  misc_feature: GZ8MTXP02F3SL7.21.25.C03.1.454.CMB.2.raw
  modified_base (311)..(311): a, c, t, g, unknown or other
  modified_base (461)..(461): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctcgcccgtggggccccagacaccggagggcggctgcgtcagcacagacgtcgggcccaggaccctgtgcagtgagcgaggagagtggaggaggagaggacgaccgaggccagtgcgtaggagtattcggtcctggaggtgcttcgcccttcgttggccgaccccanaggcctaggaacgcgaagaccgtcccctaaacccctaaacctccgtacaacttactaacgttaggtaaaacccacggtaccctaaaacggtcccccgggtcccccgttacggggaaccccggggttcccctaacggtaaacccccggttnttttcccccgtcggttacccggggtaccctaacccgttaaacggttccgttacccggacccctaaccccgttccgaacccggtccccccgttcccggttcgggtacccgtacggttcccggtcggttacccgggggtccctacccggtaacgggggtccttaacggggaacccgtaaggttacggtacggggtacctttaggttaaagttttacgttacggttacgtccccgtaacgtttaccccgttaatacccggaaaaccttaaccccgttcccgggtttacgggttccgtttttacgggggttttcgtccgggtttacgggttcccgggggacggggtacccgggtaaacggtacgttacccggg

SEQ ID NO: 401848 - DNA, 587 bp, Homo sapiens
  misc_feature: GZ8MTXP02H9YHN.21.25.C03.1.454.CMB.2.raw
  modified_base (278)..(278): a, c, t, g, unknown or other
  modified_base (283)..(283): a, c, t, g, unknown or other
  modified_base (287)..(287): a, c, t, g, unknown or other
  modified_base (381)..(381): a, c, t, g, unknown or other
  modified_base (399)..(399): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagattgtcctgagtgctgcctntgtcnccangctgaagcagacgcctaccaaactcctacatcctatacggtaacagacctaacgtccggccctcgacggggttccctcggtaccgtactttccncgtcgcctaccaacgtcncgcgacctcacgtccctcccgtgtcacgtcgcgtcgggcctccgacggtctacgacgtagtggacgtcgtagtatttattagtcgaccgtacgtaccttagtacgtaaacctaaccgtacccgtggttcggtttcgggttttcggcgtttcgggttccgggccgggtaccggtaaccgtacggtccgg

SEQ ID NO: 401849 - DNA, 578 bp, Homo sapiens
  misc_feature: GZ8MTXP02I56SG.21.25.C03.1.454.CMB.2.raw
  modified_base (278)..(278): a, c, t, g, unknown or other
  modified_base (289)..(289): a, c, t, g, unknown or other
  modified_base (421)..(421): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtggagattgcctgagtgctgcctnttgtcgcccangctgaagcagacgcctaccaaactcctcatcctatggtaaccagccaagtccggccctacgacggggttccctgacccgtattcctcgtcggcctctaacgtcgtcggcacctcacgtccctcccgtgtacnctcgcgtcgggcctccgacggtcgtcgacgagtgacggtctgtattattagttcgacgtacgtactatacgaactaacctacccgttcgtccgtttgggtttttcggtccggtttcgggttccgggtccgggtaccggggaaccgtaacggtcccgg

SEQ ID NO: 401850 - DNA, 713 bp, Homo sapiens
  misc_feature: GZ8MTXP02H896I.21.25.C03.1.454.CMB.2.raw
  modified_base (281)..(281): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggagagaggagacaggccatgctaggatattgcctgagtgctgcctgttgcgcccanagctagaagcagacgccctacaaacctccacactctaataggtaaacccagactaacgtccggacccttacggacggggttcccctaggaacccgtatttccgtacgtcggtacctaccgaaacgttccgacggtccctaaccctcgaaccgtccccgttacccgtcggttaccgaaccgttccggtccgtcccggggtccttaccggacgggtacccgttagggaacccgttaaggtacggtaacggtacgttaacgtttaacgtttaacgtttacgtaccggtaccgttaccgttaccgttaaacgtaacccgtaaacccgtaaacccgttacccgtttacgggtttacggtttttacggggtttccggtaccggttaccggggtttacccgggggaccgggtaaccccggtaaacgtaaccggtcccgg

SEQ ID NO: 401851 - DNA, 637 bp, Homo sapiens
  misc_feature: GZ8MTXP02HU49Y.21.25.C03.1.454.CMB.2.raw
  modified_base (304)..(304): a, c, t, g, unknown or other
  modified_base (472)..(472): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcgctgcgtcagcacgagacgtcgggcccaggaccctgtgcaggtgaggcgaaggagaggtggaggaggagaggagaccgaggcagtgcgtggagtattgtccgtgagtgcgtgccgttgttgccgacccagngctagaagcgtagacgtccccaactaaacctcctacaattccttaagacggtaaacagaccgtaagtccccggtccctacgggacggggttcccccaggtaactccttcgtacgcggtaccctacgaacgtcgtcggaccaccgtccgcgttcccgtcctcggtaccncgtcgcgtcggcctacggacgtcgtaggacgtgtaggacgtcgtaagttacttagttacgtcgaccgttacgtacctagaacctaaaccgtaccgtaccgttcgtttcggtttcggtttcggtcggttaccgggtcgggacccggtaccgggtaccgtacggtcg

SEQ ID NO: 401852 - DNA, 687 bp, Homo sapiens
  misc_feature: GZ8MTXP02HM8FM.21.25.C03.1.454.CMB.2.raw
  modified_base (285)..(285): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctcttgtcgccccanagctgaagcagagcctccaaactcctcatctatggtaaccagacaacgtcgccctcgacggggtccctacggaccgtactttcctacctcggggtcctacccgtaaacgttccgttcggccctaaccccgtccgaacccgtccccgttccccgtcgggttccaacgttccggtcgttcggggtacccttcccgaacgggtccgttacggaaccgggtaagtcgggtaacggtcgtaggttaactttaagtttaacgtttcggtaccctaacggttaccttaacgtacgaaacccgtaaacccgtaacccgttcggttaccgggtttcgggtttttaaccgggtccgtttacggggtttcccggggacccggggttacccgggaaccgttaaacgggtcccgg

SEQ ID NO: 401853 - DNA, 538 bp, Homo sapiens
  misc_feature: GZ8MTXP02ISMF3.21.25.C03.1.454.CMB.2.raw
  modified_base (273)..(273): a, c, t, g, unknown or other
  modified_base (283)..(283): a, c, t, g, unknown or other
  modified_base (439)..(439): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgctggagattgctgagtgctgcctntgtcgcccanagctagaagcagacgcctaccaaactcctacattcagtacgtaacagcaatccggccctcgacggggtccctagaccgtattcctcgtcgctacccaagtctggcacctcacgcctccgtgtcatcgcgtcggcctcgaggtctagaccgagtcgnggtctagtatttagttatcgcctagttcctatacgaacaaccgtaccgttcgtcgtttggttttcgcgttcggtcgggacggcggaaccgtacgtccgg

SEQ ID NO: 401854 - DNA, 552 bp, Homo sapiens
  misc_feature: GZ8MTXP02F187M.21.25.C03.1.454.CMB.2.raw
  modified_base (286)..(286): a, c, t, g, unknown or other
  modified_base (441)..(441): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcactgactgggcccaggaccctgtgcagtgagcgaggagagtgaggaggagaggagaccaggccatgctggagattgtcctgagtgctgcctcttgtcgccccanagctgaagcagcgccctccaaactcctcatctaagtggtaaacccagccaatccggaccctcgacggggtcccctgacccgtattcctctcgggacctccgtaaacgtctcggcaccgtcacgccctcccgtggtcatcgcgtgggctccgaggntcgacgtagtgaggtctagtatttataatttcgcctacgtcctatacgaacaacctacccgtcgtcgtttggtttggcgttggttccggcggtacggaacctacggtaccg

SEQ ID NO: 401855 - DNA, 600 bp, Homo sapiens
  misc_feature: GZ8MTXP02JPEUV.21.25.C03.1.454.CMB.2.raw
  modified_base (255)..(255): a, c, t, g, unknown or other
  modified_base (369)..(369): a, c, t, g, unknown or other
  modified_base (384)..(384): a, c, t, g, unknown or other
  modified_base (440)..(440): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtcctgagtgctgcctcttgtcgcccacagctaggaacgcagacgcctacccaaaacctctacattctaatggtaaacccagacaactcggcccttcggacggggttcccngaacccgtattccgngtcggccttaccaaacgtctacggccaccctcgacgtccctacccgtggttacccncgtccgtcgtcggtcctccgagtcgtacggacgtacgtaggaggtacgtagttatttacgttacgtacgacctacgtacctataccgaacctaaccgtccgtacggttcggtttggtttcggtcggttcggtcgggaccgggtacggtaacgacggtccg

SEQ ID NO: 401856 - DNA, 692 bp, Homo sapiens
  misc_feature: GZ8MTXP02GKQVA.21.25.C03.1.454.CMB.2.raw
  modified_base (288)..(288): a, c, t, g, unknown or other
  modified_base (336)..(336): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccgaggccatgctggagattgtcctgagtgctgccttctgtcgcccanagtctgaagcagacgcctaccaaacctcctacatctatacggtaaccngacaacgtccggccctcggacggggtccctgaccgtattccgtacgtcggcctaccgtagtcgtcggacctacccgtcgaccgtccctccccgtgtctacgtccgtcgttcggggccctccggacgggtcctaggaaccggtagtcgggtaacggtccgttaggttaacttttaagtttaacgttccgtaacccgttacgttaccccgtttaagtaacccggtaaaaccctaaaccccgttaccccggttacgggtttaccgggtttttcggggttttttccgggtcccgggttttcggggttacccgggggtacccgggtacccgggggtaaacccgtaaccggtttccccgggg

SEQ ID NO: 401857 - DNA, 501 bp, Homo sapiens
  misc_feature: GZ8MTXP02FU8H1.21.25.C03.1.454.CMB.2.raw
  modified_base (350)..(350): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctaccaaactcctcatctatggtaaccagcaatcggccctcaggggtcccngaccgattctctggctccaagtctggcacctcagccctccctggtcatcgctgggctccgaggctgacgatgaggctgtattattattgcctacgtctatcgacaacacccgtgcgttggttttggcttcgttcggcggcggaccagtccg

SEQ ID NO: 401858 - DNA, 580 bp, Homo sapiens
  misc_feature: GZ8MTXP02H72VR.21.25.C03.1.454.CMB.2.raw
  modified_base (281)..(281): a, c, t, g, unknown or other
  modified_base (421)..(421): a, c, t, g, unknown or other
tcagtcgtcgctcgcacgaccggtgctcgatttagtagtgtagatttgggtttgggggctgttcctggaagttgctgataccagtgcacatcaaaaggtgaccccgatgttggagctgctcccagcgcaggagatggtgaccgtctgccctggggccccagacaccgagggcggctgcgtcagcacagactggcccaggaccctgtgcagtgagcgaggagagtgaggaggagaggagacaggccatgctggagatgctgagtgctgctcttgtcgccacngctagaagcagacgcctaccaaactccacatctatgtaaccagacaacgtccggccctcgacggggtcccctaggaacccgtatttccgcgtcggactcccaaagtccgtaggcctacctcacgtccctccgtggtaccncgtcgcgtcggtcctccgaggtctagacgtagtaggacgtctagttatttagttacgttcgaccttaacgtaccttacgtacgaaacctaaccgtcccgtggttcggttttaggtttcggtcgttcgggtacgggaccgggtaccggaacgtacggccg

SEQ ID NO: 401859 - DNA, 552 bp, Homo sapiens
  misc_feature: GZ8MTXP02GIPK9.21.25.C03.1.454.CMB.2.raw
  modified_base (275)..(275): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgcgccccanagctagaagcagacgccctaccaaactcctacatctagtggaaccagacaagtccggccctacgtacggggtcccctgacccgtattcctcgtcggtcctaccgaagtcgtcggccacctcacgccctccgtgcagtccgcgtcgggcctccgacggtctaggacgtagtcgaggtctagtatttattatcgactacgtcctatcgaactacgtaccgtgtccgtttggtttcgcgttcggttacggcggtacggaccgacgtccg

SEQ ID NO: 401860 - DNA, 633 bp, Homo sapiens
  misc_feature: GZ8MTXP02FKMPX.21.25.C03.1.454.CMB.2.raw
  modified_base (289)..(289): a, c, t, g, unknown or other
  modified_base (464)..(464): a, c, t, g, unknown or other
  modified_base (575)..(575): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactcgggcccaggaccctgtgcagtgagcgaggagagtgaggaggagaggagaccaggcatgcgtggagtattgctgagtgctgccttcgtgtcgacccanagctagaacgcagacgtaccctaaccaaacctcctactaactcttaaagtacggtaaaacccacgacctaaaacgtccccggtacccttacgggaccggggttcccctacggaacccgttatttcccgtcgttacggacctacccgtaaagttccgtaccggaccaacccgttcncccgtccctcccggttggtccctacgtcccgcgtaccggggtccctaccggacggcctaggtaacgtagtccggaaggtcttagtactttaattacgtcactacgtctaanacgtaaccaacgtccgtgtcgtttggttcgtcgttcggtcggacgacggacacgtccg

SEQ ID NO: 401861 - DNA, 642 bp, Homo sapiens
  misc_feature: GZ8MTXP02G7ZTT.21.25.C03.1.454.CMB.2.raw
  modified_base (277)..(277): a, c, t, g, unknown or other
  modified_base (365)..(365): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagacgtgggcccaggaccctgtgcagtgagcgaggagagtggaggaggagaggagaccgaggccatgctggagattgcctgagtgctgcctntgtcgccacgagctgaacgcagacgcctaccaaactcctacatctagtcgtaaccagacaagtccggaccctcggacggggttccccnggtaacccggtcttccgtccgtacgggtacctaccgaaacgttcgtcggtacccacccttccgtaacggtcccctttcccgtggtacccgtcgtccggtaccggttccggggcccttacccggaacgggtcgttacggaccggagttaaccggggtacgtacgttagttatttacgttacgtcgtaccgtacgtactagtacgaacctaccgtccgttcggttcggtttcggtttcggtcgttcgggtcgggtaccggtaccggtacgtacgtccgg

SEQ ID NO: 401862 - DNA, 561 bp, Homo sapiens
  misc_feature: GZ8MTXP02HRYKQ.21.25.C03.1.454.CMB.2.raw
  modified_base (292)..(292): a, c, t, g, unknown or other
  modified_base (369)..(369): a, c, t, g, unknown or other
  modified_base (377)..(377): a, c, t, g, unknown or other
  modified_base (455)..(455): a, c, t, g, unknown or other
  modified_base (465)..(465): a, c, t, g, unknown or other
  modified_base (471)..(471): a, c, t, g, unknown or other
  modified_base (478)..(478): a, c, t, g, unknown or other
  modified_base (487)..(487): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtggagtattgtcctgagtgctgccttcttgtcgccccanagcctgaagcagacgccctacaaacctcctacattctatacggtaaccagcaactccggtccctcggagggtccccngtaaccgntttcctcgtcggtccttaccgagtctcggcctaccgtcacgtccctccctggtcactcgcgtggctcgagtctgacgntgagctagtnttattntcgtacncgttactanacgaccctaactacccgtggttccgtttggttttcgcggttcggtttccggggcggtccggaactacggtaccg

SEQ ID NO: 401863 - DNA, 579 bp, Homo sapiens
  misc_feature: GZ8MTXP02HD3WP.21.25.C03.1.454.CMB.2.raw
  modified_base (290)..(290): a, c, t, g, unknown or other
  modified_base (381)..(381): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtccgtgagtgctgtcctcttgtcgcccanagctgaagcagcaccctaccaaactcctacatctagtacgtaaaccagtaccaagtccggtccctacggacggggtccctcggaaaccgtnttccgtcgtcggccttaccgaagttcgtcgccaccgtcacgtcctcctcgtctcgtcgtcgtcggcgtcgcgcgtacgacgagtagtggtacgtagtattattacgttacgtccgtacgtactacgtacgtacaacctacccgtcgttcggttcggtttcggttcgtcggttcgggcggtaccggaccgtacgtacgg

SEQ ID NO: 401864 - DNA, 633 bp, Homo sapiens
  misc_feature: GZ8MTXP02IIIDP.21.25.C03.1.454.CMB.2.raw
  modified_base (292)..(292): a, c, t, g, unknown or other
tcagtcgtcgctcgcacgaccggtgctcgatttagtagtgtagatttgggtttgggggctgttcctggaagttgctgataccagtgcacatcaaaagggtgacccgatgttggagctgctcccagcgcaggagatggtgaccgtctgccctggggccccagacaccgagggcggctgcgtcagcacagactcgggcccaggaccctgtgcagtgagcgaggagagtgaggaggagaggagacgaggccatgcgtggagtattgtcctgagtgctcgcctcgttgcgacccanagctagaagcagacgccctaccaaactcctacatctaagtacggtaaaccagacaacgtccggaccctcggacggggtccctagaaccgtcttccgtcgtcggcctaccgaacgtcgcggacctacctcgaccgtccctccgtcgtcacgtccgtcgtcggtacctcgacggtcgtagaccgagtcggaacgtcgttaagtacttttaagttacgttaccgtaccgtacgttaccgttaagtaccgtaaaccctaaccgttacccgttcggtttaccggttttcgggttttcggtcgttcggggttacccgggcgggtaccgggaaccgtaacggtcccgg

SEQ ID NO: 401865 - DNA, 847 bp, Homo sapiens
  misc_feature: GZ8MTXP02IR9IF.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagtattcgtcctaggacgtgccgtcggtcccttgtttcgccgaccccaagacgctagaagccgaagacgacccctaaccctaaactcctacaacttcgtaaagtacggtaaaacccaggtacctaaacgtccccggtacccctttacggggaccggggtttcccccgtagggtaaccccgttacgttttccccgtaccgggtttaccgggacccttaaacccgtaaaccggttccgttaccgggaccctaaacccccggttccaaacccggttacccccgttccccggttcgggttaccctaaccgttccccgggttaaccggttcccggggtacccgttaaccccgggtaacgggttcccgttacgggaaacccgggtagttaccgggaacggttaccgttaagttaaacgttttaagttacgttacggtaacccgttaacggtaccctttaagtaaccgtaaacccgttaaacccgtacccggtttagggttacccgggtttttaggggtttttaaccggtccgggtttaacggggtttacccgggggaccgggtaacccgggggtaaaccttaaccgggtttaccccggg

SEQ ID NO: 401866 - DNA, 579 bp, Homo sapiens
  misc_feature: GZ8MTXP02FI13A.21.25.C03.1.454.CMB.2.raw
  modified_base (287)..(287): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgcctcgttgcgcccanagctagaagcagacgcctaccaaactcctacatctataggtaaccagacaatccggccctcggacggggttcccctagaaccgtattcctcgtcgcctaccgaagtcgtcggcacctcacgtcccctccgtgtcacgtccgcgtcgggcctacgacggtctaggaacgagtcggaaggtcttaaggtatttatacgttcgacctacgttacctagtacgaaacctaacctcccgttggtcggttttggtttcggcgttcgggttccgggacgggtaccggacctaggtcccg

SEQ ID NO: 401867 - DNA, 583 bp, Homo sapiens
  misc_feature: GZ8MTXP02JSZNU.21.25.C03.1.454.CMB.2.raw
  modified_base (288)..(288): a, c, t, g, unknown or other
  modified_base (445)..(445): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgttcccagcgcaggagatggtgaccgtctgccctggggccccagacaccgagggcggctgcgtcagcacagactgggcccaggaccctgtgcagtgagcgaggagagtgaggaggagaggagaccgaggccatgctggagattgtcctgagtgctgcctcttgtcgccccanagctagaagcagacgcctaccaaactcctacatctaagtggtaaacacgacaatccggccctcggacggggttccctggacccgtattcctcgtggccctacaagtctcggccacctcgacgtccctacccgtggtctacgtcgcgtcggcctccgnggcgtgacgagtggagtctagtattacttatcgtacagttacctatacgaacctacctaccgttcgtcggttttggttttacgcggttcgggttccggggaccgggtaccgggtaacccaacggtccgttaacccggg

SEQ ID NO: 401868 - DNA, 548 bp, Homo sapiens
  misc_feature: GZ8MTXP02G3TS3.21.25.C03.1.454.CMB.2.raw
  modified_base (264)..(264): a, c, t, g, unknown or other
  modified_base (276)..(276): a, c, t, g, unknown or other
  modified_base (285)..(285): a, c, t, g, unknown or other
  modified_base (357)..(357): a, c, t, g, unknown or other
  modified_base (460)..(460): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagattgtccngagtgctgcctntgtcgccangctgaagcagcgcctaccaaactctacatcctataggtaacagcaagtccgccctgacgggtccctgacgtnttctctggcctcaagtctcggctacctcacgtccctcctggtccacgttcgcgttcgggcttcccgaggtcctggaccgagttcggacggtcttagtaatttnttagtcgtactacgtacctagtacgaacctaaccgtccgtcgttcggtttggtttcgcgttcgggtcggaccggacggtacgacgtcg

SEQ ID NO: 401869 - DNA, 562 bp, Homo sapiens
  misc_feature: GZ8MTXP02JD4H1.21.25.C03.1.454.CMB.2.raw
  modified_base (255)..(255): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgcctgagtgctgcctcttgcgcccanagctgaagcagacgccctaccaaactcctcatctatggtaaccagcaaactccggccctgacggggttcccctaggacccgtatttcccgtctcgggcctaccctaaagtcttcggaccacctcacgcccttcccgtacggtccagtccgccgtgggcctccgcggctgacgatggagtctgtattattattcgacctacgtactagtacgtaacaaccacccttggtcgtttggttttcggtcgttcggttccgggcggaccggtaccgacggtccg

SEQ ID NO: 401870 - DNA, 622 bp, Homo sapiens
  misc_feature: GZ8MTXP02FUQYO.21.25.C03.1.454.CMB.2.raw
  modified_base (277)..(277): a, c, t, g, unknown or other
  modified_base (287)..(287): a, c, t, g, unknown or other
  modified_base (293)..(293): a, c, t, g, unknown or other
  modified_base (326)..(326): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccagtggctggagtattgtcctgagtgctgcctnttgcgcccangctgancagacgccctacaactctacatctatggaaccngacaagtccggccctacggacggggtcccctaggacccgtatttcctacgtcggtaccctaccgtaacgtcgtcggaccacccgtcgacccgtcccgtcccgttcgtccgacgtcgccgttcgggccctccgacgggtccgtaggtaacgagtacggacggtcgtacgttaagtttagtttacttccggtacctaacgttccttaataccgtaaacctaaccgtacccgttgttcccggttttgggttttcgcggtttcgggttcggggaccggaccggggaacctacggtcccgg

SEQ ID NO: 401871 - DNA, 567 bp, Homo sapiens
  misc_feature: GZ8MTXP02HR1QG.21.25.C03.1.454.CMB.2.raw
  modified_base (286)..(286): a, c, t, g, unknown or other
  modified_base (329)..(329): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctgaagcagacgcctaccaaactcctcattctatggtaacngacaatccggcctcgacggggtccctagaccgtattcctctggcctaccgaagtctcggcctacctcacgtcccttcccgtggtctacgtcgtcgtcgggctccaggtctgacgtatgagctgtatttattagtcgacctagttcccttatacgaacctaacctacccgtcgttccggtttggtttttcggtcgttcgggtttccgggccgggtccggggtaaaccgtacggtacccg

SEQ ID NO: 401872 - DNA, 604 bp, Homo sapiens
  misc_feature: GZ8MTXP02F42IH.21.25.C03.1.454.CMB.2.raw
  modified_base (281)..(281): a, c, t, g, unknown or other
  modified_base (293)..(293): a, c, t, g, unknown or other
  modified_base (327)..(327): a, c, t, g, unknown or other
  modified_base (340)..(340): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtagggagattgtcctgagtgctgcctnttgtcgccccanagctggaagcagacgccctaccaaactcctcatntagtaggtaaccngacaacgtccggcccctcggacggggtcccctggacccgtattccgtcgtcggcctaccgtaagtccgtcggccaaccttcacgtccctcccgtgtacctacgtcgtcgtcgggtcctccgaggtctacggaacgtagtcggaggtacttagtaatttaattacgttcgacccgtacttacctagtacgaacctaaaccgtacccgttcggtacgttttggggtttcgtcgttcgggttcgggccggtacgggaaccagtcccg

SEQ ID NO: 401873 - DNA, 564 bp, Homo sapiens
  misc_feature: GZ8MTXP02GH93R.21.25.C03.1.454.CMB.2.raw
  modified_base (275)..(275): a, c, t, g, unknown or other
  modified_base (285)..(285): a, c, t, g, unknown or other
  modified_base (424)..(424): a, c, t, g, unknown or other
  modified_base (440)..(440): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccagtgctggatattgctgagtgctgcctntgtcgcccangctagagcagacgccctacaaactcctactatctagtagtaaccagaccaagtccggccctcggacggggtccctaggacctattcctcgtcggcctaccgtaagtccgtcggccacctcacgtccctcccgtgctacnccgctcgggcctccgnggcgtagacgagtacggaggtctagttattagttactacgtcctaacgttcctagtaccgaaacaacctccgtcgttcggtttcggtttcgtcgttcgggtcggaccggtcggacgtacgtccg

SEQ ID NO: 401874 - DNA, 658 bp, Homo sapiens
  misc_feature: GZ8MTXP02HFXTF.21.25.C03.1.454.CMB.2.raw
  modified_base (223)..(223): a, c, t, g, unknown or other
  modified_base (248)..(248): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagngaggaggagaggagacgagcagtgngtggatagttgcctgagtgtcgtcgtccttcgtgtccgaccagacgcgtaggaacgcagaccgtaccctaacccaaactcctacacttactaagtacgtaaccacgtactaacgtcccgcccgtacgggtaccgggtcccgtacggtacctacgttccgtcgtacggtaccctacgtaacgttccgtccggtaccctacccgtacgacccgtccccttaccgtcggtacctacgttccggccggttaccggtccccttacggacggtctacggaacgggtgtaccgggtagtacttaggttaatttacgttagttaccgacccgtttagtaccctataccgaaacctaacctcggttcggtgttttcggttcggcgtttcgggccgggacggtaccgtacgtacggtccg

SEQ ID NO: 401875 - DNA, 753 bp, Homo sapiens
  misc_feature: GZ8MTXP02HHAP2.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactcgggcccaggaccctgtgcagtgagcgaggagagtggaggaggagaggacgaccgaggccagtgcgtggagtattggtcctggagtgctcggtcccttcgttggccgccccaacgacggtctaggaaacgcgaaggtaccgtacccctaaccctaaaaccttcctactaacttaccgttaaagtacgggtaaaacccacggtacctaaaacgtcccgggtacccctacgggaaccgggggttccctacgggtaacccgtatttccgtacgtcggaccttaccgtaacgtcgtcggacctacccgtcaccgtcccttcccgtcggtccacgttccgcggtcgggtccctaccggacgggtcgtacggacggtacgtacgggacgggtcttaaggttaatttacgtttacgttacgtacccgttacggttacccgttaactaccggtaaaccctaaacccgtcccgtttacgggttaccgggtttttcggggtttttccggtaccggtttcgggggtttaccggggaccggggtaacccgggtaaccggtaacggttccccggg

SEQ ID NO: 401876 - DNA, 620 bp, Homo sapiens
  misc_feature: GZ8MTXP02J1Z7Q.21.25.C03.1.454.CMB.2.raw
  modified_base (254)..(254): a, c, t, g, unknown or other
  modified_base (279)..(279): a, c, t, g, unknown or other
  modified_base (284)..(284): a, c, t, g, unknown or other
  modified_base (311)..(311): a, c, t, g, unknown or other
  modified_base (356)..(356): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagacaggccatgctgganattgcctgagtgctgcctcttgtcncccangctagagcagacgcctacaaactcctnatctatacggtaacagcaacgtccggccctaggacggggttcccnggacccgtattccgtacgtcggtaccctacccgaagttccgtcggaccctaccctcgaccgtcccctcccgtcggtccacgttccggcgttaccggggtccttcccgaggtccgtaggaccggtatcggacggtcgtagtactttagttacgttcgaccgtacgttcctaacgtacgtaaccctaaaccgtcccgtggtttccggttttgggttttcggcgtttcgggttccgggtaccgggtaccggtaaccgtacgtcccgg

SEQ ID NO: 401877 - DNA, 709 bp, Homo sapiens
  misc_feature: GZ8MTXP02G8U97.21.25.C03.1.454.CMB.2.raw
  modified_base (308)..(308): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacgagacgtgggcccaggaccctggtgcagtgagcgaggagagtgaggaggagaggagaccgaggcagtgctggagtagttgtcctgagtcgctcgtccttcttgtcgccccacagctagaancgagacgccctacccaaactcctacatctagtacgtaaccagacaacgtcccggacctacggaccgggtccctcgtaaccgtcttccgtcgtaccggtcctaccgtaagtccgtcggccctaccctccaccgtcccttccccgtggtacctaccgtcgtccggtccgggtccctaccggtacggtcgtacggacgtaggtacggaggttaccgttaggttaactttaacgtttacgttaccgtacccttaacggttaccccttaagttaaccggtaaaccccctaaaaccggttccccggttacgggtttccggtttttcgggttttaaccggttcgggttacccggggtttccgggggacccgggtttacccgggaaacccggtaacggttcccccgggg

SEQ ID NO: 401878 - DNA, 477 bp, Homo sapiens
  misc_feature: GZ8MTXP02IIF5D.21.25.C03.1.454.CMB.2.raw
  modified_base (437)..(437): a, c, t, g, unknown or other
  modified_base (458)..(477): a, c, t, g, unknown or other
tcagtcgtcgctcgcacgaccggtgctcgatttagtagtgtagatttgggtttggggctgccctttggttttggagatggttttctcgatgggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccatgccgtccagtaccagttgaactggacactggtcaccgtctctcagcctccaccaaggccccatccggtcctccccctggccgccctgcctccaggacgccaccctccgagacgccacgagtccggcccccgtggggcctcggcccgtggtaccaaacgggcttaccgttcccgaagcccgaacgctgacggccgggntggccaagggccgataagtgnnnnnnnnnnnnnnnnnnnn

SEQ ID NO: 401879 - DNA, 564 bp, Homo sapiens
  misc_feature: GZ8MTXP02GDB95.21.25.C03.1.454.CMB.2.raw
  modified_base (289)..(289): a, c, t, g, unknown or other
  modified_base (336)..(336): a, c, t, g, unknown or other
  modified_base (486)..(486): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagtattgtcctgagtgctgcctcttgtcgcccanagctagaagcagacgcctaccaaactcctacatctaatggtaaccanacaacgtccggccctacgacggggtcccctgaccgtattcctcgtggcctaccaacgtctcggacctacctcgaaccgtccctcccgtcggtcctacgtccgcgttcgggtcctccgaggtcctaggacgagtcggagtctagtactttntacttgcctacgtctatacgaacaacctcccgtagtcggtttggtttcgcgttcggttcgggcggtcggacacgtccg

SEQ ID NO: 401880 - DNA, 716 bp, Homo sapiens
  misc_feature: GZ8MTXP02FWDYU.21.25.C03.1.454.CMB.2.raw
  modified_base (276)..(276): a, c, t, g, unknown or other
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccaggccatgcgtggagattgtctgagtgctgcctntgtgcccanagctagaagcagacgccctaccaaactcctacatctagtaggtaaaccagacaaatccgaccctcgaacggggttcccacgaccgtatttccgtcgtcggaccttacccgaaagttccgtacggtaccctaacccgttccgtaacccggtcccccttcccccgttagggttaccctaacgttcccggtccggttcggggtcccttacccgaacgggtccttacgggaaaccggtagtacgggtacgggtacctttaggtaaattttacgtttacgtttacggaccccttaaacgttcccgttaaagttaccgaaaaccctaaaaccccgttccccggttaggttccgggttttacgggtttttccgggtcgttttaccggggttaccgggggcccggggtaaccgggggtaacccgtaacgggttacccgg

SEQ ID NO: 401881 - DNA, 667 bp, Homo sapiens
  misc_feature: GZ8MTXP02GINRT.21.25.C03.1.454.CMB.2.raw
  modified_base (294)..(294): a, c, t, g, unknown or other
  modified_base (329)..(329): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcggctgcgtcagcacagacgtgggcccaggaccctgtgcagtgagcgaggagagtggaggaggagaggagaccgaggccagtgctggatattgtcctggagtgctgtcctgttgtcgcccanagcgtagaagcaagacgccctaccaaacctcctanattctagtacggtaaccacgacctaacgtcccggccctcggaacggggtccccctaggaccccgttatttccgtccgtggcccttaccgaacgttccgtaccggtcccaacccgttcgacccgtccccgtcccgttgtccacgtccggtcgttcgggccctaccgacggtccaggaccgtagtacggaggtacttagttaatttacgttacgttcgacccgttaggttacccttaagtaccgtaaacctaaacccgtcccgttggttccgggtttttggggtttccgacggtttccggggttaccgggaccgggtacccggtaacctaacgggtcccg

SEQ ID NO: 401882 - DNA, 538 bp, Homo sapiens
  misc_feature: GZ8MTXP02JATDE.21.25.C03.1.454.CMB.2.raw
  modified_base (255)..(255): a, c, t, g, unknown or other
  modified_base (274)..(274): a, c, t, g, unknown or other
  modified_base (284)..(284): a, c, t, g, unknown or other
  modified_base (375)..(375): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgcctgagtgctgcctntgtgccccanagctgaagcaggacgcctacccaaaactcctacatcctaatacggtaaccagcaagtccggccctcgacgggtccctagacccgtattccngtcggcctacccaagtctcggccaccgtcacgccctccctggtcactcgcgtcgggcctccgaggtctcggacagtgacggtctaggtattattatcgcctaagttcctatcgaacaactcctcggtcttggtttgcgttcggtcgggcgtcggacgagtccg

SEQ ID NO: 401883 - DNA, 806 bp, Homo sapiens
  misc_feature: GZ8MTXP02JRNZE.21.25.C03.1.454.CMB.2.raw
  modified_base (277)..(277): a, c, t, g, unknown or other
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggccagtgcgtggagattgtcctgagtgctgccttntgtcgccctanagctagaagcagacgaccctaccaaaaccttcctactaactctaagtagggtaaacccaggtaccctaaacgtccccgggtaccccctacggtaccgggggttccccctagggtaacccgttacgtttcccgtcccggtttcgggacccttacccgtaaaacggttcccgttaccggggacccctaccccgtaccgtaacccgtcccccttacccggttacgggtccctaacggtttcccggccggtttccgggggcccttaaccgggacgggtccgttaacgggaaccggtagtacgggtaacggttccgttacggttaattttaaacgtttacgtcggtaccccgttaacggtttacccctaagttaaccggaaaacccccttaaaacccgggtttcggttaacccggggtttttggggtttttaccgggtaaccggtttaccgggggttttacccgggggacccggggttacccggggtaaacccgaaaccgggtcccggtttaaacccccgggg

SEQ ID NO: 401884 - DNA, 656 bp, Homo sapiens
  misc_feature: GZ8MTXP02HBBY4.21.25.C03.1.454.CMB.2.raw
  modified_base (273)..(273): a, c, t, g, unknown or other
  modified_base (529)..(529): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagacaggcatgcgtggagtattgctgagtgctgcctnttgtcgcccagagctagaacgcagacgccctaccaaactcctactaattcctagttacggaacccaggacctaaacgtccggtacccttacggaccggggttcccctaggtacccgtactttccgtaccgttcggcccttaacccgtaaacggttccgttaccggccctaacccgttccgacccggtccccttccccggtcgggtacctacgtccgtcgtcggggacccttacccggagggtcctaggaccgtagnggtacgtcgttagttaactttattacgtcacgttacgtacctaagtaccgaaacctaccgtaccgttcggttacgtttcgggtttcgtcggtttcgggtccgggacggtaccggaacgtacggtccg

SEQ ID NO: 401885 - DNA, 578 bp, Homo sapiens
  misc_feature: GZ8MTXP02FQN4N.21.25.C03.1.454.CMB.2.raw
  modified_base (428)..(428): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggcatgctggagattgtctgagtgctgcctcttgtgcccacagctgaagcagacgccctacccaaaactccctacatctatggtaaccagccaatccggccctcgacggggtcccctgaccgtattctctggctccaagtctcggcacctcacgccctccctggtccatcgcgtcggggcctccgnggctgacgtagtcggaggcttagtatttattagtttcgcccgtacgtcccttatacgaaccaaccgtaccccgttcgtcggttttggggtttttaaggtccgtttcgggtttccggggtccgggaccggggtaacccgaacggtacccgg

SEQ ID NO: 401886 - DNA, 581 bp, Homo sapiens
  misc_feature: GZ8MTXP02F743V.21.25.C03.1.454.CMB.2.raw
  modified_base (289)..(289): a, c, t, g, unknown or other
  modified_base (344)..(344): a, c, t, g, unknown or other
  modified_base (461)..(461): a, c, t, g, unknown or other
  modified_base (492)..(492): a, c, t, g, unknown or other
  modified_base (568)..(568): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccagtgcgtggagattgtcctgagtgctgtcctcttgacgccccanagctaggaagcagacgccctaccaaaacctcctacatacctagtaggtaaacccngaccaagtcccggtcccctacggaccgggggttccctacggacccgtatttccgtcgtcggaccctaccgtaaagttcctcggacctaccctctaccgtcccctccccgtggtaccncgtcgcgttcgggcctccgaggcctgaacgntacggagtcgtagtatttagtatcgactacgtctagtacaactaccaccgtgtcgtttggtttgcgttcggtcggngtcgtcgactacg

SEQ ID NO: 401887 - DNA, 615 bp, Homo sapiens
  misc_feature: GZ8MTXP02FL2S8.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgctggagtattgtcctgagtgctgccttcgttgtcgccccacagctaggaagcgaagacgtaccctaccaaacctcctacactcttaatacggtaaacccaggccaaagtcccggcccttacggaccggggttccctaggacccgtatttccgtctcggccttaccaaacgttcctacggaccctacccgtcacgtccctcccgtaggtcctacgttccgcgtcggggtcctaccgacgggtctacggacggaagttggaggtactaggtatttaattagttcgactacgttctaagtacgaaacctacctacccgttggtcgtttggttttcggcgttcggttcgggcgtcgggaaccgagtccg

SEQ ID NO: 401888 - DNA, 541 bp, Homo sapiens
  misc_feature: GZ8MTXP02G01S9.21.25.C03.1.454.CMB.2.raw
  modified_base (284)..(284): a, c, t, g, unknown or other
  modified_base (406)..(406): a, c, t, g, unknown or other
  modified_base (452)..(452): a, c, t, g, unknown or other
  modified_base (458)..(458): a, c, t, g, unknown or other
  modified_base (489)..(489): a, c, t, g, unknown or other
  modified_base (517)..(517): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtggaggaggagaggagaccgaggccagtgcgtggagtattgtcctgagtgctgccttnttgtcgccccacagctagaagcagacgccctaccaaactcctacatactagtacgtaaccagacaacgtcccgcccgtacggacgggtccctagaccgtacttcctcgtcgcctacacgtcncggcctacgcgctccctccgtgtcacgtcgcgtcggcctcgacgcncgacgngtagcgtctatattgttatcgctacgtctanacgacacctcgtcggtcgtttggttcgngttcggtcggcggacgacagtccg

SEQ ID NO: 401889 - DNA, 530 bp, Homo sapiens
  misc_feature: GZ8MTXP02FJIE9.21.25.C03.1.454.CMB.2.raw
  modified_base (285)..(285): a, c, t, g, unknown or other
  modified_base (297)..(297): a, c, t, g, unknown or other
  modified_base (357)..(357): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagngcctaccaaactcctacatctaatggtaaccagacaagtccggccctgacggggtccccngaccgtattctcgtggcctaccaagtctggccacctcacgtcccctcccgtggtccagtccgcgttgggcctccgaggctggacgagtcgaggctagtattattattcgactacgtctatcgaaccaacacccgtgtcgttgtttggcgttcggttcggcggtcggacagtcg

SEQ ID NO: 401890 - DNA, 565 bp, Homo sapiens
  misc_feature: GZ8MTXP02H3GJ4.21.25.C03.1.454.CMB.2.raw
  modified_base (275)..(275): a, c, t, g, unknown or other
  modified_base (285)..(285): a, c, t, g, unknown or other
  modified_base (316)..(316): a, c, t, g, unknown or other
  modified_base (467)..(467): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctagagtgctgcctnttgtgcccanagctagaagcagacgccctacaaactcctanatctatgtaacccagacaatccggccctggaacggggtccctggaaccgtacttctctcggcttacccgaaagttcgcggctaccctcgacgtccccttcccgtggtcacgtccgcgtcgggcttacccgaggtcctggacgagtcggagngtgtattattatagtactacgtacgtacttacgtacgaactaccctacgtcgttggttttcggtcgttcggttcggtcggaccggtaccgaacgtacg

SEQ ID NO: 401891 - DNA, 606 bp, Homo sapiens
  misc_feature: GZ8MTXP02HIAES.21.25.C03.1.454.CMB.2.raw
  modified_base (250)..(250): a, c, t, g, unknown or other
  modified_base (437)..(437): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagacaggccatgngtggagattgtcctgagtgctgtccctgttgcgccccaagacgtctaggaacgcaagacgcctacccaaactcctacaattctagtacgtaaaccagcaacgtccggccctacggtacggggtccctagaccgtattccgtcgtcggccttaccgaagtctggcctaccgtcacgccctccgtgtcncgtcgcgtcggcctccgaggtctacgacgagtggacgtgtagtatttagttacgttcgaccgttacgtaccgtagtaccgtaaaccaaaccgtaccgttcggttcggtttcggttttaacggtcggtttacggtcccggggtcggggtacccggaaacgtaacggtccg

SEQ ID NO: 401892 - DNA, 556 bp, Homo sapiens
  misc_feature: GZ8MTXP02JV9CU.21.25.C03.1.454.CMB.2.raw
  modified_base (280)..(280): a, c, t, g, unknown or other
  modified_base (286)..(286): a, c, t, g, unknown or other
  modified_base (298)..(298): a, c, t, g, unknown or other
  modified_base (314)..(314): a, c, t, g, unknown or other
  modified_base (328)..(328): a, c, t, g, unknown or other
  modified_base (370)..(370): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgcnccctanagctgaagcagngccctccaaactcctnatctatggtaaccngcaagtccggccctcgacggggtccctaggaacccgattccnctggccttaccaagtcttggccacctcacgccctccctggtcagttcgctgggcctcgagggctaggacgatcgagggtctagtatttattagtttcgcctacgttcctagtccgaactaaacctacccgtcggtccgtttgggttttcggcttcgggttccgggacggccgggtaccaggtaccg

SEQ ID NO: 401893 - DNA, 764 bp, Homo sapiens
  misc_feature: GZ8MTXP02I4T3G.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcgctgcgtcagcacagactgggcccaggaccctgtgcagtgagcgaggagagtggaggaggagaggacgaccgaggccagtcgcgtagggagtattcgtcctaggagtcgctgtcccttcgtttagccgaccccagacgtactaggaaacgccaaaggaccgtaccccttaaacccaaaacccttccctactaaactttacctaaaggttacggtaaaaaccccacggtaaccctaaacggtccccgggtacccccttacggggtaacccgggggttccccctacgtaacccggttatttcccgtcggttcgggacccttaacccgtaaacgtccgttacggaccctacccgtccgtaccgtccccgttcccgtggtacctacgtccgtcgttacgggccttaccggacggtcctacggaaccgtagtcggacggtactaggttaattttaacgttcgttacggtacctacggttaccttaacgtaccgtaaaccctaaaaccgttacccgttcgggtttccggtttttgggttttcggtccggtttcgggttaccgggggaccgggtaccgggtaaccgtaacggttcccg

SEQ ID NO: 401894 - DNA, 627 bp, Homo sapiens
  misc_feature: GZ8MTXP02JJ7G7.21.25.C03.1.454.CMB.2.raw
  modified_base (367)..(367): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaaaccagacaatccggccctcgaacggggtccctgacccgtattccncgtaggctaccaagtctggcactcacgcctcctcggtcagtcgctgggctcgagctgacgatgacggtctaggtactttagttacgtttcgacccgtaacggttcccttaattaccggtaaaccctaaaaccccgtaacccccgtttacggggttcccggtttttgggggttttttaaccggggtacccgtttcggggttttacccgggggcccggggtacccgggggttaaacccccgtaaaacggggtttaccccggg

SEQ ID NO: 401895 - DNA, 765 bp, Homo sapiens
  misc_feature: GZ8MTXP02FW72G.21.25.C03.1.454.CMB.2.raw
  modified_base (289)..(289): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccaggccagtgcgtggagtattgtcctgagtgctgcctctgtcgcccangctagaagcaagacgccctaccaaacctcctacatctaagtcggtaaacccagaccaacgtcccggcccctacggaccggggttcccctacgaacccggtatttcccgtacgttcggaccttaccgtaaacggttcctcgggaccctaacccgttccgacccggtcccccttccccggttagggtaccctacgtccggtccggttacgggggtcccttacccggacggtccgttacgggaacccggtaagtccggggaacgggttaccttagggtttaaacttttaaagttcgtttaccgggtaacccttacggttaacccttagtaaaccggtaaaccctaaaacccgttaccccggttaggggtttcccggggtttttaggggtttttaaccgggtcccggtttaacgggggttttaccccggggggccccgggggttaaccgggggtaaaccccggtaaacggtttccccggg

SEQ ID NO: 401896 - DNA, 634 bp, Homo sapiens
  misc_feature: GZ8MTXP02HLX41.21.25.C03.1.454.CMB.2.raw
  modified_base (274)..(274): a, c, t, g, unknown or other
  modified_base (284)..(284): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgcctgagtgctgcctnttgcgcccanagctgaagcagacgcctaccaaactcctcatctatggtaaccagacagtccggccctcggacgggtccctgacccgtattcctctcggctacctaagtctcggcctaccgtcacgtccctcccgttggtacctacgtccgcgtcgggtcctcccggacggtccgtcggtaaccggagttacggaggtcgtaggttaactttagtttaacgttcgtaacccgtacggtttacccttaagtaccgaaaccgtaaacccgtacccgttcggttaccggttttcggggttttttcggccggttttcgggtttccggggacccggggtacccggggtaaccgtaacggttcccgg

SEQ ID NO: 401897 - DNA, 552 bp, Homo sapiens
  misc_feature: GZ8MTXP02IDSPO.21.25.C03.1.454.CMB.2.raw
  modified_base (207)..(207): a, c, t, g, unknown or other
  modified_base (250)..(250): a, c, t, g, unknown or other
  modified_base (320)..(320): a, c, t, g, unknown or other
  modified_base (327)..(327): a, c, t, g, unknown or other
  modified_base (340)..(340): a, c, t, g, unknown or other
  modified_base (360)..(360): a, c, t, g, unknown or other
  modified_base (369)..(369): a, c, t, g, unknown or other
  modified_base (442)..(442): a, c, t, g, unknown or other
  modified_base (462)..(462): a, c, t, g, unknown or other
  modified_base (490)..(490): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccttctgccctggggccccagacaccgagggcggctgcgtcagcacagactgggcccaggaccctgngcagtgagcgaggagagtgaggaggagaggagaccaggccagngctggagtatgcctgagtcgctgcctcttgtcgcccagagctagaagcagacgtcctaaccaaactccanatctagngtaaccagctaanccggacctcggacgggtccncgtaaccgnttctcgcggtctaccgacgttcgcgtaccacctcaccgtcccttccgtgtccagtccgcgtcggacctccggngtcgtagacgagtcgaggtntagtatttgttagtcgtactacgtctanacgtaacaccgtaccgtgttcgtttggtttcgtcgttcggtcggcggtaccgtacgtacgcg

SEQ ID NO: 401898 - DNA, 629 bp, Homo sapiens
  misc_feature: GZ8MTXP02JHIEL.21.25.C03.1.454.CMB.2.raw
  modified_base (254)..(254): a, c, t, g, unknown or other
  modified_base (273)..(273): a, c, t, g, unknown or other
  modified_base (284)..(284): a, c, t, g, unknown or other
  modified_base (297)..(297): a, c, t, g, unknown or other
  modified_base (404)..(404): a, c, t, g, unknown or other
  modified_base (430)..(430): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgcctgagtgctgcctntgtagccccanagctgaagcgagngccctaccgaaactccctcatacctattacggtaaacccagtcaaacgttccggcccttacgacggggtcccctagacccgtattcctctggcctacaaaggttccncggacctaccgtcacgtcccttccgngtccacgtcgcgtcgggcctcggacggtctacggacgtacgtacggacgtcttagtaacgtttacgttagtacgtaccgttacgttcctaaagtaccgtaaaccctaaaccgtacccggttacggtttaccgggttttacgggttttaacggtccggttcggggttaccggggcgggtaccggaacccgtaacggtccg

SEQ ID NO: 401899 - DNA, 582 bp, Homo sapiens
  misc_feature: GZ8MTXP02FJ2ML.21.25.C03.1.454.CMB.2.raw
  modified_base (286)..(286): a, c, t, g, unknown or other
  modified_base (332)..(332): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgtagtgagcgaggagagtgaggaggagaggagaccaggccatgctggagattgtcctgagtgctgcctcttgtcgcccanagctagaagcagacgccctaccaaaactccacatctatggtaaacncgacaatccggccctcgacggggtccctgaccgtattcgtctggcctaccaagtctcggccacctcacgtccctccctcggtcacgtccgcgtcgggtcctccgaggctaggacgagtggacggtctagtaatttagttattacgacctacgttacctatacgtaaccaaacctacccgttcggttccggtttgggtttttcggcgttcgggttccgggccggggtaccgggaccgaacggtccgtacgg

SEQ ID NO: 401900 - DNA, 880 bp, Homo sapiens
  misc_feature: GZ8MTXP02IQHTZ.21.25.C03.1.454.CMB.2.raw
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagactcgggcccaggaccctgtgcagtgagcgaggagagtggaggaggaggaggacgacgaggccagtgcgtggagtagttcggtccgtaggagttcggccgttcggtcccttcgttcggtaccgaccccaacgagggtccttacgggaaacggacccgtaaggaaccgtacccccttaaacccctaaaacccgttcccttaacctaagttacctttaaagggtaacggttaaaaccccgaccgtaaccgtaaaccggttcccccgggggtacccccttaaccggggttaacccggggggttcccccttacgggtaaaacccccggtttacgttttccccgtccggggttaccggggtacccctttaacccggtaaaccgggtttcccgttaacgggaccccctaaacccccgttcccggtaacccggttccccccgtttacccggttcgggtaaccctaccggtcccggtccgggtaccggggtcccctaccggggaccggttcccggttaacgggaccgttacggtaacgggtaccggttacgtaggtttaaacctttacgtttacgttccgaacccgtttactaccgtaaccgttacaaacccgtacccgttacccgttggttacccgggttttgggtttcggtcggttcggttcccggggacgggttaccggaaaccgtcgtaccggg

SEQ ID NO: 401901 - DNA, 523 bp, Homo sapiens
  misc_feature: GZ8MTXP02GW83L.21.25.C03.1.454.CMB.2.raw
  modified_base (255)..(255): a, c, t, g, unknown or other
  modified_base (275)..(275): a, c, t, g, unknown or other
  modified_base (285)..(285): a, c, t, g, unknown or other
  modified_base (352)..(352): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgtcctgagtgctgcctnttgtgcccanagctgaagcagacgcctaccaaactcctcatctatggtaacagcaatcggccctcgacggggtcccngaccgtattcctctcggctaccaagtctggcacctcacgtccctccctggtccagtccgcgtcgggcctccgacggtctgacgatcgaggtctgtattatattcgacctacgtctatcgaacaaccacccgttgcgtttggtttgcttcggttcggcggtcggacagtccg

SEQ ID NO: 401902 - DNA, 593 bp, Homo sapiens
  misc_feature: GZ8MTXP02IYK51.21.25.C03.1.454.CMB.2.raw
  modified_base (243)..(243): a, c, t, g, unknown or other
  modified_base (256)..(256): a, c, t, g, unknown or other
  modified_base (284)..(284): a, c, t, g, unknown or other
  modified_base (293)..(293): a, c, t, g, unknown or other
  modified_base (335)..(335): a, c, t, g, unknown or other
  modified_base (429)..(429): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcggaggagagtggaggaggagaggagacnggcagtgctgganattgctgagtgctgcctcgtgtcgccanagctagaancaagacgcctaccaaactcctacaactctaagtacggaaccncgacaacgtccgcctacgaggggtccctaggacctcttcgtcgtcggccttaccgaacgttcgtagaccctcctacgcgccctcccgtcgtccncgtccgtcgtcgtcgtcgcgcgacgacgtagtagtagtacgtagtacgttacgttacgtacgtaccgtacgtacgtactacgtaacctaaccgtaccgttacggttcggtttcggtttcggttcggttcggttccgggtaccgggtaccggtaccgtacggtcg

SEQ ID NO: 401903 - DNA, 795 bp, Homo sapiens
  misc_feature: GZ8MTXP02JZXF0.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctgggccccagacaccgagggcgctgcgtcagcacagactggcccaggaccctgtgcagtgagcgaggagagtgaggaggagaggagaccaggcagtgcgtaggagtattgtcctgagtcgctgccttcgttgtcgacccanagctagaacgcaacggacgtcccctaaccaaaaccttcctacgtaactttaccgtaaaggttaacgggtaaaacccacgtaaccgtaaaccggttaccccgggcccccgtttacgggacccgggggtttcccccgtacgggtaaacccggttactttccgtccgttacgggtacccttaaccggtaaacgttcccgttacggaccctaacccgtaccgtacccggtcccctttacccggtcggttacctaacggtttcccggcgttaaccgggggcccttaccggaacggtccgtaacgaccggtagttacggacggtacttaggttaatttacgtttacgtaccgtaccgttaaccgtttacccgtaaagtacccgtaaaaccgtaacccgttacccgttagggtttcccgggttttttaaggggttttcccgggacggtttttacccggggttccgggggaccccgggttaacccggggtaaacccgtaacggtttccccggg

SEQ ID NO: 401904 - DNA, 675 bp, Homo sapiens
  misc_feature: GZ8MTXP02FRMOX.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagattgtcctgagtgctgtcctcttgtcgcccacagctagaacgcagacgccctaacccaaactccctacatactaagtacggtaaaccacgacaacgtccggccctcggtacggggtccctgacccgtattccgtctcggccttacctaagtctacggcctacccgtcaccgtccctcccgttggtcctacgtccggccgtcggggtccctcccggtacggtccgtacggaccgtagtaccgggtagcgttagttaatttagtttaacgtccgtacctaacgttacccttacgtacgtaaacccgtaaaccgttaccccggttcggtttccgggttttggggtttttaacgggtcccggtttacgggggtttcccgggggacccggggtaaccggggtaaacccgtaaacggttccccgg

SEQ ID NO: 401905 - DNA, 674 bp, Homo sapiens
  misc_feature: GZ8MTXP02HWTUP.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggcccaggaccctgtgcagtgagcgaggagagtgaggaggagaggagaccgaggccatgctggagattgcctgagtgctgcctcttgtcgcccanagctgaacgcagacgcctccaaactcctacactctaatggtaaaccagacctaagtccggacccttcggaacggggtcccctagaccgtactttccctacgtcgggaccttacccgaaagttccgtacggacccaccttcgaccgtccctcccgtcggtccacgtccgtcgtgggcccttccgacggtcgacggtacgaacgtggacggtcgttaggtatttaacgtttgttacgtaccgttacgttacccgtttaagaccggaaaccctaaaaccgttacccccgttaggttacccgggtttttggggttttttaaccggtccggtttacggggtttcccgggggaccggggtacccggggtaacccgttaaacggggttaccccggg

SEQ ID NO: 401906 - DNA, 740 bp, Homo sapiens
  misc_feature: GZ8MTXP02IKJOV.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggagagaggagaccaggccagtgctggagtatgcctgagtgctgcctgttgcgacccanagctagaagcagacgaccctaccaaactcctacatctaagtacggtaaacccagaccaacgtcccggacccttacggacggggttcccctaggacccgtactttcccgtacgtcgggaccttaccgtaaacgttcgtaccggacctaccctaccgtaccgtccccgtccccgttacggtaccgtacgttaccgtaccggtcgggtacccgtacccgtacgggtaccgtacggtaacgtaacgttacggacggtacgttagttaacgtttaagtttacgttacgtacccgttaacgttacccgttaaacgttaaccgtaaaccgtaaacccgttaaccccgttaccgggttaccggttttacgggttttaaccgggttcccgggtttaccgggtttcccgggggtaaaaacccggggttcccggggtaaaacccggtaaaccggtttaaccccggg

SEQ ID NO: 401907 - DNA, 576 bp, Homo sapiens
  misc_feature: GZ8MTXP02G6RLI.21.25.C03.1.454.CMB.2.raw
  modified_base (286)..(286): a, c, t, g, unknown or other
  modified_base (315)..(315): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtcgcccanagctagaagcagacgcctaccaaactccncatctatggtaacagcaatccggccctcgacggggtcccctgacccgtattcctctcgggcctaccgaagttcctcggacccaccgtcacgtcccttcccgtggtccacgtccgtcgtcggggacctccgacgggtctacggacgtagtggacggtctagtaatttattagtcgacctacgtcctatcgaaactaacctaccgttcgtacggtttcggttttcggcttcgggttacggccggaccgggtaccaacggtccg

SEQ ID NO: 401908 - DNA, 544 bp, Homo sapiens
  misc_feature: GZ8MTXP02F615W.21.25.C03.1.454.CMB.2.raw
  modified_base (221)..(221): a, c, t, g, unknown or other
  modified_base (279)..(279): a, c, t, g, unknown or other
  modified_base (286)..(286): a, c, t, g, unknown or other
  modified_base (369)..(369): a, c, t, g, unknown or other
  modified_base (438)..(438): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagngtgaggaggagaggagaccaggccatgcgtggagattgtcctgagtgctgcctcttgngcccaangctagaagcaagacgcctccaaactcctacatctagtggtaaccagcaatccgccctacgacggggtccctgaccgtattccncgtgcctcaagtctggcacctcacgccctccgtcggtcacgtcgcgtcgggcctccgacggctgaccgngtacggaggactgtactttattatcgctacgtacctatacgtaaccaacctaccgtcgtcgtttcggtttcgtcgttcggttccggcggtaccggacgacgtacgg

SEQ ID NO: 401909 - DNA, 521 bp, Homo sapiens
  misc_feature: GZ8MTXP02JS503.21.25.C03.1.454.CMB.2.raw
  modified_base (255)..(255): a, c, t, g, unknown or other
  modified_base (273)..(273): a, c, t, g, unknown or other
  modified_base (283)..(283): a, c, t, g, unknown or other
  modified_base (309)..(309): a, c, t, g, unknown or other
  modified_base (322)..(322): a, c, t, g, unknown or other
  modified_base (348)..(348): a, c, t, g, unknown or other
  modified_base (352)..(352): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgctgagtgctgcctntgtcgcccanagctgaagcagacgcctacaaactcncatctatgaaccngcatccgcctgcgggtccctgacgtnttcntcgctacagtctgcacctcacgtcctcctggtcacgtccgtcgtcgggccttccgaggtctacggacgagtcgaggcttagtatttattagttcgacctagtacctatacgaccaacgtacccgtggtcgtttggtttcgcgttcggtcgggcggaccggtacagtccg

SEQ ID NO: 401910 - DNA, 552 bp, Homo sapiens
  misc_feature: GZ8MTXP02FZMRF.21.25.C03.1.454.CMB.2.raw
  modified_base (275)..(275): a, c, t, g, unknown or other
  modified_base (279)..(279): a, c, t, g, unknown or other
  modified_base (286)..(286): a, c, t, g, unknown or other
  modified_base (299)..(299): a, c, t, g, unknown or other
  modified_base (314)..(314): a, c, t, g, unknown or other
  modified_base (354)..(354): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctnttgngcctacngctgaagcagacncctaccaaactcctnatctatcggtaacagcaatccggccctgacggggtccccngaaccgtattctctggcctccaatctggccacctcacgtccctccctggcagtcgctgggcctccgaggtctgaacgatcggacggctagtaactttagttattcgacctaacgtcctaatcgaaacctaaccacccgttggcgttttggtttaacggtccttcgggttccgggccggtacgggaaccgtaacgtccg

SEQ ID NO: 401911 - DNA, 846 bp, Homo sapiens
  misc_feature: GZ8MTXP02F695L.21.25.C03.1.454.CMB.2.raw
tcagtcgtcgctcgcacgaccggtgctcgatttagtagtgtagatttggggtttgggggctgttcctggaagttgctgataccagtgcacatcaaaaggtgacccgatgttggagctgcctcccagcgcaggagatggtgaccgtctgccctggggccccagacaccggagggcgctgcgtcagcacgagacgtcgggcccaggaccctgtgcagtgagcggaggagagtggaggaggagaggagaccgaggccagtgcgtagggagtagttcgtcgtggtacgtcgcgttcggtcccttcgttcggtccgaccccaagacggctaaggaagaccaacggacctaccccttaaaccctaaaacccttccttaacctaacgttaccgttaaaggttaaccggaaaacccgtacggaacctaaacggttcccggggacccccgttaccggggtaacccggggttccccctacgggtaaccccggttacttttcccgtaccggttccgggacccttaaacccgtaacggttaccgtcccggtaccctaacccgtccgtaacccgttcccccgtaccccggtttcggtaccaaccggtcccggtaccgggttccggggaccccttaaacccggcgggtaccgttacgggaaaccggtaggtaaccggtacggggtactttaaaggttaaattttacgttacgttcggtaccctaacggtttaccctaaagtaacccggtaaaacctaaacccgttccggttacgggttccggttttttacgggggtttaacggttccggtttcggggtacccggttaccgggggaccggtaacccgtaacggtttcccgg

SEQ ID NO: 401912 - DNA, 603 bp, Homo sapiens
  misc_feature: GZ8MTXP02G4PBB.21.25.C03.1.454.CMB.2.raw
  modified_base (250)..(250): a, c, t, g, unknown or other
  modified_base (255)..(255): a, c, t, g, unknown or other
  modified_base (263)..(263): a, c, t, g, unknown or other
  modified_base (272)..(272): a, c, t, g, unknown or other
  modified_base (280)..(280): a, c, t, g, unknown or other
  modified_base (321)..(321): a, c, t, g, unknown or other
  modified_base (361)..(361): a, c, t, g, unknown or other
  modified_base (366)..(366): a, c, t, g, unknown or other
  modified_base (429)..(429): a, c, t, g, unknown or other
  modified_base (477)..(477): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagacaggccatgntgganattgctgngtgctgctntgcgccangctagagcagcgcctaccaaactccacatctatagtaaccngactagtccggccctacggacggggtccctagtaaccctnttccncgttcggacctacccgtaaagtccgtcggtaccaacccgtcgaccgtcccgtcccgtgtaccncgtccgcggtcggtcctacgacggtcgacggtacgtagtacggacgtnttagtaatttacgttactcgtacctacgtactaacgaccgtaaaccgtaaccgttccgtcggtttacggttttgggtttcggtcggtttcggggtccggggacccgggtacggtaactacggtccg

SEQ ID NO: 401913 - DNA, 701 bp, Homo sapiens
  misc_feature: GZ8MTXP02GJYF4.21.25.C03.1.454.CMB.2.raw
  modified_base (207)..(207): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactcgggcccaggaccctgngcagtgagcgaggagagtggaggaggagaggagaccaggcagtgcgtaggagtagttcgtccgtgagtcgctcgtcccttgttcggtccgacccaacgaggtcctagaaacgcgaacgtacgcccttaacccaaactcctcaacttctaacgtacggtaaacccaggacctaaccggtccggtaccccgttaccggtaccgggggttcccctacgggtaaccggttactttccgttaccggtcggtaccgttaacctaaacgttccgttacggccctaacccgtccgaacccgtccccgttacccgttcggtaccctacgttccgccgtccgggtccaccggacgggtctacgggacgtagtcggaaccgggttattagttatttagttacgtcgtacgtacgtactacgtaccgaaacctaccgtaccgttcggttcggtttcgggtttcgtcggttacggtaccggggccggtaccggtaccgtacggtccg

SEQ ID NO: 401914 - DNA, 687 bp, Homo sapiens
  misc_feature: GZ8MTXP02JRUAT.21.25.C03.1.454.CMB.2.raw
  modified_base (275)..(275): a, c, t, g, unknown or other
  modified_base (280)..(280): a, c, t, g, unknown or other
  modified_base (284)..(284): a, c, t, g, unknown or other
  modified_base (387)..(387): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctntgtcnccanagctagagcagacgcctaccaaactcctacatcgtaagtcggaaaccctacgacctaacgtccggtccccgtacgacggggtcccctagaaccggtacttccncgtcggtcctaccgaacgtccgtcggaccacctcacgtcccctcccgtcggtactcgtccgtcgttcgggccttccggacgggtctacggaacgtacgttggaacgggtcttaggtaatttaactttacgttacggtacccttaacggttaccgtaaaggtacccgttaaacccgaaaccccgttaacccgggtttacggtttccgggttttaacggggtttttcgggtcccggtttacggggttttaccccgggggcccgggggttacccgggaaaccgggtaaaccggtttccccggg

SEQ ID NO: 401915 - DNA, 703 bp, Homo sapiens
  misc_feature: GZ8MTXP02F0MG3.21.25.C03.1.454.CMB.2.raw
  modified_base (290)..(290): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgcgtggagtattgtcctgagtgctgtcctcgttgtcgcccanagctagaagcagacgccctaccaaacctcctacatctaagtacggtaaaccagaccaaagtccggaccctcggacggggttccccaggaccctagtttcctcgtcggacctaccgaagtcgtcggcctaaccgtcacgtcccctcccgtggtcctacgtcgtcgtcgggtcctaccgacggtctacggacgtagtacggacggtacttaggtaaatttacgtttagttaccggacccttaacggttaccccttaaagtaccgtaaaacccgttaaacccgttacccccggtttaacgggttcccggggtttttacggggtttttccgggtacccggggttttaccggggtttcccggggggtacccgggggttacccgggggaaaacccgttaaacggggtttaacccccggg

SEQ ID NO: 401916 - DNA, 613 bp, Homo sapiens
  misc_feature: GZ8MTXP02I68NH.21.25.C03.1.454.CMB.2.raw
  modified_base (287)..(287): a, c, t, g, unknown or other
  modified_base (299)..(299): a, c, t, g, unknown or other
  modified_base (332)..(332): a, c, t, g, unknown or other
  modified_base (359)..(359): a, c, t, g, unknown or other
  modified_base (370)..(370): a, c, t, g, unknown or other
  modified_base (385)..(385): a, c, t, g, unknown or other
  modified_base (402)..(402): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggcccagacaccgagggcgctgctcagcacagactgggcccaggaccctgtgcagtgagcgaggagagtggaggaggagaggacgaccaggccagtgctgggagtattgcctgagtgctgcctgttgcgcccangctagacgcagnccctaccaaactcctacatctagtcgaaacccngacctaatccggcctacggcgggtccngaccgtattcntcggctcgtacgtcncgaccactcacgtcccnccgttaggtcagtccggcgtcggggtacctccggacggtccctaggaccgtagtacggagtacttaggtatttacgttacgtacggtacctaggtaccctttacacggaaaacccttaaacccgtcccgtttgggttaccggttttagggttttcgggtccggtttcgggtaccgggggtcgggaacccgggaccgttaaaggtccccggg

SEQ ID NO: 401917 - DNA, 645 bp, Homo sapiens
  misc_feature: GZ8MTXP02FOB8V.21.25.C03.1.454.CMB.2.raw
  modified_base (294)..(294): a, c, t, g, unknown or other
  modified_base (302)..(302): a, c, t, g, unknown or other
  modified_base (325)..(325): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccagtgcgtaggagtattcgtctgagtgggctgcctgttgcgccccangctagaancagcaccctaccaaacctcctanactactagtaggtaaaccagactaacgtccggtccctacggtacccggggtccctacgacccgttattccgtcgtacggtcctacgtaacgttcgtacggaccacccgtcgtacccgtccctcccgttcggtacctcgtccgtcggttaccggggcccttaccggacggccgttacgacggtaggtcggtaacggtcgttagttaatttacgttacgttcgacttacgtcttaacgtacgaaccctaaccgttccgttcggttcggttttggtttcggtcgttcgggtccgggcgggtaccggtaaccgacggttcccgg

SEQ ID NO: 401918 - DNA, 662 bp, Homo sapiens
  misc_feature: GZ8MTXP02HKSC7.21.25.C03.1.454.CMB.2.raw
  modified_base (211)..(211): a, c, t, g, unknown or other
  modified_base (220)..(220): a, c, t, g, unknown or other
  modified_base (269)..(269): a, c, t, g, unknown or other
  modified_base (287)..(287): a, c, t, g, unknown or other
  modified_base (292)..(292): a, c, t, g, unknown or other
  modified_base (305)..(305): a, c, t, g, unknown or other
  modified_base (310)..(310): a, c, t, g, unknown or other
  modified_base (373)..(373): a, c, t, g, unknown or other
  modified_base (380)..(380): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcaacgagacgtgggcccagggaccctgngcagtgagngaggagagtaggaggaggaggaggagaccgaggccagtgcgtaggaagnttgctgagtgctgccttntggcncccagagtcagancagcnccctacaaactcgacatctataggaaccagcacgtccgacctgacgggttccctggaaccgtntttccgnttcggacctacgtaagttcgcggcctaccgcacgtcccctccgtcgtcacgtccgcgtcgggcctcgacgtcgtacggacgtagtagaggactaggtaatttacgttacttacgaccctttacgtaaccctttaggaaaccgtaaaccgtaaacccttaccccgggtaggtttttcccgggggttttagggttttttaaccggggtccggtttacccggggttttacccggggggcccggtttaacccgggggaaccccgtttaaaacgggtacccccgggg

SEQ ID NO: 401919 - DNA, 687 bp, Homo sapiens
  misc_feature: GZ8MTXP02GP2SY.21.25.C03.1.454.CMB.2.raw
  modified_base (287)..(287): a, c, t, g, unknown or other
  modified_base (301)..(301): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagtattgtcctgagtgctgcctgttgtcgcccangctagaagcagacncctaccaaactcctcatctaagtagtaacccagacctaacgtcccggaccctacggacggggtccctagaccgtattcctcgtcggtcctaccgaagtcgtacggctaccctcgacccgtcccttccccgtaggtccctacgtccgtcggttccgggcctacccggtacggtccgttacggaacggtacgttacgggacgggttaccttaggttaaacttttaagtttacgtttcggaccccttaaacggttccccgttaaagttaccgaaaccctaaaacccgtaccccgtttggggttacccggtttttaggggttttccgggtacggtttacgggggttcccggggaccggggtaccgggtaacccgtaacggttaccccggg

SEQ ID NO: 401920 - DNA, 559 bp, Homo sapiens
  misc_feature: GZ8MTXP02GK2ML.21.25.C03.1.454.CMB.2.raw
  modified_base (261)..(261): a, c, t, g, unknown or other
  modified_base (286)..(286): a, c, t, g, unknown or other
  modified_base (328)..(328): a, c, t, g, unknown or other
  modified_base (374)..(374): a, c, t, g, unknown or other
  modified_base (419)..(419): a, c, t, g, unknown or other
  modified_base (436)..(436): a, c, t, g, unknown or other
  modified_base (456)..(456): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagacgtcgggcccaggaccctgtgcagtgagcgaggagagtgaggagagaggagacaggcatgctggagtatcgtcngagtgctgcctcgttgtcgacccanagctagagcagcgcctacaaactctacatctagtacgtaacncgacctaagtccggacctcggacgggtcccagtacctactcctcgnggaccttacgagtcctacggccactcgactccctcccgtgtaccncgtcgcgtcgcctcggngtcgtagacgagtcgacgtntagttattattcgtactacgtacttactacgtaccgaacctaccgtacgtcgttcggtttggttcggtcggttcggtaccgggacggtacggtacgtacgtcg

SEQ ID NO: 401921 - DNA, 672 bp, Homo sapiens
  misc_feature: GZ8MTXP02F3JYP.21.25.C03.1.454.CMB.2.raw
  modified_base (144)..(144): a, c, t, g, unknown or other
  modified_base (278)..(278): a, c, t, g, unknown or other
  modified_base (289)..(289): a, c, t, g, unknown or other
  modified_base (298)..(298): a, c, t, g, unknown or other
  modified_base (390)..(390): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtntgccctggggccccagacaccgagggcggctgcgtcagcacagactgggcccaggaccctggtgcagtgagcggaggagagtggaggaggagaggagaccaggccatgctggagattgcctgagtgctgccttntgcgaccctanagctagaancagacgccctacaaacctcctactatcgtaagtacggtaacccagacctaacgtcccgggaccctacggaccggggtccctagaaccggttntttccgtcgtacggcctacaaacgttctcggacctacctcgaccgtccctcccgttggaccctacgttccgcgttacgggcccttaccggacggtaccgtcgggaaccgttagtacggaccggtacttaaggttaaccgtttattaacgttccggtaacccctaaggttccctaacgtacggtaaaccctaaaccgtacccgttcgggttacgttttcggggttttaacggtccgtttacggggttcccggggaccggttacgggaaccgtaacggtcccgg

SEQ ID NO: 401922 - DNA, 886 bp, Homo sapiens
  misc_feature: GZ8MTXP02F79RD.21.25.C03.1.454.CMB.2.raw
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcggctgcgtcagcacagacgtgggcccaggaccctgtcgcagtgagcggaggagagtggaggaggagaggaagaccgaggtaccagtcggcgtagggagtagttcggtcctaggaggtcgtcttcggtccttcgtttacggtccggaccccaagtacggtaccgtaggaaacgtccgaagggaacccgtacccctttaaccccgaaaacccgttcccttactaaacgttaccgttaaacggttacggttaaaaccccgagtacccctaaaccggttcccccggggtacccccggttacgggaacccggggggtttcccccttcgggaaaacccccggttgtttttaccccgtccggtacgggtaacccttacccggtaaacgtttccgacgggaacccttacccgtcacccggttcccccgttacccgttacgggtaccttaccggcccggttcggtttaccgggggcccttacgggaacccggtccgttaaacgggaaaccgttcggttacgggggaatttccgttaaacggtttaactttagtttaagtacccgtttacccggaacctttacgggtactaaaccggaaacccctaaaccgttaccccggtttaggttccccggggttttttaggggtttaaccgggtcccggtttcggggttaacccggggggaccgggtttacccggaaccggttaaacgttcccccgggg

SEQ ID NO: 401923 - DNA, 606 bp, Homo sapiens
  misc_feature: GZ8MTXP02FQAZT.21.25.C03.1.454.CMB.2.raw
  modified_base (281)..(281): a, c, t, g, unknown or other
  modified_base (292)..(292): a, c, t, g, unknown or other
  modified_base (338)..(338): a, c, t, g, unknown or other
  modified_base (366)..(366): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccgaggccagtgcgtaggatagttgtcctgagtgctgccttnttgtcgcccangctagaagcagcgcctacccaaactcctacatctagtaggtaaccngacaagtccggccctcggacgggtcccngaccgtattctcgtcggcctaccgaacgtcgtccggtaccaccctcctaccgccccgttaccccgttggtacccacgttccgcgttcggggaccctccgacggctagaccgtagtacgagtctagtaatttattacgtcgctacgtctagtacgaacctaaaccgtccgttacggttcggttttggttttcggtccgttcgggttccggggaccggtaccgggaaccgtaacggttcccg

SEQ ID NO: 401924 - DNA, 727 bp, Homo sapiens
  misc_feature: GZ8MTXP02HLUC2.21.25.C03.1.454.CMB.2.raw
  modified_base (277)..(277): a, c, t, g, unknown or other
  modified_base (286)..(286): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacagactgggcccaggaccctgtgcagtgagcgaggagagtgaggaggagaggagaccgaggccatgctggagattgtcctgagtgctgcctntgtgcccanagctgaagcagacgccctacaaactcctacatcctaagtggtaaacccagaccaacgtccggaccccttcggaacgggggttccccctaggacccgtatttcccgtacttcggggtaccctacccgtaaacgttcccgttcgggaccctacccgttacccaccgttcccccgttccccgtcgggttcccacgttcccgggccgttcgggggtccctacccggtaacggggtccgttacgggaacccgggtagtacggtacgggtaccttaggttaactttaagtttaacgttcggtaacccgttaacgggttaccctaagttaaccgaaacccgtaaaaccgttccccgttacggttcggttttacggggtttttcgggtaccggtttcgggggtttaccgggcccggggtaccgggggtaaacccgttacgggtacccgg

SEQ ID NO: 401925 - DNA, 624 bp, Homo sapiens
  misc_feature: GZ8MTXP02FSC3A.21.25.C03.1.454.CMB.2.raw
  modified_base (295)..(295): a, c, t, g, unknown or other
  modified_base (311)..(311): a, c, t, g, unknown or other
  modified_base (619)..(619): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgcccgtggggccccagacaccggagggcggctgcgtcagcacagactgggcccaggaccctgtgcagtgagcgaggagagtggaggaggagaggagaccgaggccagtgcgtggagtattgtcctgagtgctgtccttgtgtcgcccangctagaagcaagaccncctaacccaaactcctacatactaagtacggtaaaccagacctaacgtcccggtacccctacggtaccggggttccctaggaacccgttatttcccgtcgtcgggccttaacccgtaaagttccgcggtacctaacccgtcgaccgttccccctccggttggtacctacgtccggtccgttcgggccctacggacggcgtacgacgtagtcggaggtctagttaacttagttacgtcgacctacgtaccgtatacgaaacctacgtccgttgttccggtttgttcgtcgtcggtcggcggtacgaccngtccg

SEQ ID NO: 401926 - DNA, 589 bp, Homo sapiens
  misc_feature: GZ8MTXP02GXTQV.21.25.C03.1.454.CMB.2.raw
  modified_base (254)..(254): a, c, t, g, unknown or other
  modified_base (274)..(274): a, c, t, g, unknown or other
  modified_base (285)..(285): a, c, t, g, unknown or other
  modified_base (396)..(396): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacaggctgggcccaggaccctgtgcagtgagcgagagagtgaggaggagaggagaccaggccatgctgganattgtcctgagtgctgcctnttgtcgcccanagctgaagccagacgcctaccaaactcctcatctatcggtaaccagcaagtccggccctacggacggggtccctgaccgtacttccgcgtggcctccgaagtcgtcggacnccgtcacgtccctccgtcggtcacgtcgcgtcgggctccgaggtcgtacgacgtacgtgacggtctagtaatttagttacgtcggtaccctacggttaccctaagtacgtaacctaaaccgtacccgttcggttccggtttggttttcggcgtttcgggttaccgggaccgggtacggaaccgtaagtcccgg

SEQ ID NO: 401927 - DNA, 592 bp, Homo sapiens
  misc_feature: GZ8MTXP02FW600.21.25.C03.1.454.CMB.2.raw
  modified_base (285)..(285): a, c, t, g, unknown or other
  modified_base (369)..(369): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctctgtgcccangctgaagcagacgcctaccaaactccgtacatctataggtaaccagccaatccggcctcgacggggtcccctgaccgtattccncgtacggcctaccgaaagtccgtacggccacccgttcacgtccctcccgtggtcacgttccgcgtgggcctacgacggtctagaacgatacggaggtcttggtaatttattaacgtttcgaccctaggttacccttaatacggaaacctaaacctcccgttagtccggtttaggttttcggcgtttcggttccggggccggtaccgggtaacccgagtcccgg

SEQ ID NO: 401928 - DNA, 562 bp, Homo sapiens
  misc_feature: GZ8MTXP02HC7SW.21.25.C03.1.454.CMB.2.raw
  modified_base (292)..(292): a, c, t, g, unknown or other
  modified_base (300)..(300): a, c, t, g, unknown or other
  modified_base (317)..(317): a, c, t, g, unknown or other
  modified_base (328)..(328): a, c, t, g, unknown or other
  modified_base (404)..(404): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtggaggaggagaggagaccgaggccagtgctggatattgtcctggagtgctgtccttgttgcgccccanagctagancagcgcctaccaactcnatcatgaaccngacacgtccggcctggacggggtcccagtacctatttccgcgtcgcctacagtctcggccactcacgcccttccgngtcacgtcgcgtacggcctccgaggtcctagaccgagtcggagtctagtactttatcttcgacccttagtaccctagtacggaacctaaacccgtccgttcggtacggttttgggtttcgcgtttcggggtaccggcggacccggaactacggtcccg

SEQ ID NO: 401929 - DNA, 656 bp, Homo sapiens
  misc_feature: GZ8MTXP02H7S4G.21.25.C03.1.454.CMB.2.raw
  modified_base (218)..(218): a, c, t, g, unknown or other
  modified_base (280)..(280): a, c, t, g, unknown or other
  modified_base (290)..(290): a, c, t, g, unknown or other
  modified_base (293)..(293): a, c, t, g, unknown or other
  modified_base (321)..(321): a, c, t, g, unknown or other
  modified_base (459)..(459): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccggagggcggctgcgtcagcacgagacgtcggcccaggaccctgtgcagtgagngaggagagtggaggaggagaggagacgaggcatgcgtggatattcgcgtgagtgctgccttntgtcgcccangtntagaagcagacgccctaccaaacttccntatactagtagaaccccagactaccgtccggtccctcggtacccggggttccctcggtaaacctctttccgtccgacggccttaacccgaagttccgacggaccctaccgtccgccgtcccgttacccgtcgttaccncgtccgtacggtccgggtcctacccggaggtaccttagggaccgtagtacggagtacgtagttatttacgttacgtacgaccgttaacttcttaggacctaacccgtaaaccgtaccgtttcggtttcggtttttcgggttttcggccggtttcggggttacgggacccggggtaccggtaccgtaaccgtccccgg

SEQ ID NO: 401930 - DNA, 717 bp, Homo sapiens
  misc_feature: GZ8MTXP02I62FD.21.25.C03.1.454.CMB.2.raw
  modified_base (533)..(533): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagaccaccggagggcggctgcgtcagcacagacgtcgggcccaggaccctgtgcagtgagcgaggagaggtgaggaggaagaggacgaccgaggccagtgcgtaggatagttcgtcgtaggagtcgctcgacccttcgttgaccgacccctaagaggtccgtaggaacgaccgaacggccgtaacccctaaccctaaacctccctacgtaacttacgtaacgtacggtaaacccacgtacctaaccgtccccgggtacccctaccgggtaccggggttccctacggtacccgtacgtttcccgtgtaccgggtccctaaccggtaacgttccgtacggtacccaccctcgtacccgtcccgtcccgtagtaccncgtcccgtcggttaccgggcccttacgggacggtctaacgggtacgtaacgtcggaaccggttcgttaaaggttatttagtacggtccaaccgtactttacgtacgtaaacaacccgtaccgttccgtgggtttcggtttcggtttgccgtttaacggtcgggtacggacgtacccgagtccgg

SEQ ID NO: 401931 - DNA, 524 bp, Homo sapiens
  misc_feature: GZ8MTXP02GGD68.21.25.C03.1.454.CMB.2.raw
  modified_base (285)..(285): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccanagctgaagcagacgcctacccaaactcctacatctatcggtaacagcaaatccggccctgacggggtcccctgaccgtattccgctggcctaccgaagtctcggcacctcacgccctccctaggtcatccgctgggcctccgaggctgacgatgaggtctgtattattattcgctagtcctatcgactaaccgacctgccggttggtttgcgttggttacggcggtcggaccaagtccg

SEQ ID NO: 401932 - DNA, 643 bp, Homo sapiens
  misc_feature: GZ8MTXP02GUIDO.21.25.C03.1.454.CMB.2.raw
  modified_base (304)..(304): a, c, t, g, unknown or other
  modified_base (490)..(490): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccagtgcgtaggagtattcgtcctaggagtcggtctcgtccttcgttgtccgccccagngtctaggaacgctaggacctaccctaacccaaacgttccctacaattcgtaagtacggtaaaccacggacctaacgtcccggacccttccggaacggggttcccctagaccccgttatttcctcgtcggacccttaccgtaacgtcctacggccctaccctcacccgtccccttcccgtggtaccnccgtcgccgtcgggtcctaccggagtccgtagtaccggtagtacggacgtcgttagtatttacgtttatcgtaccctagtcctaagtcgaacctaactccgtcgttcgtttggttaacggtcgttacggttcgggcggacgaccgtcgtaccg

SEQ ID NO: 401933 - DNA, 531 bp, Homo sapiens
  misc_feature: GZ8MTXP02IAQ1W.21.25.C03.1.454.CMB.2.raw
  modified_base (255)..(255): a, c, t, g, unknown or other
  modified_base (274)..(274): a, c, t, g, unknown or other
  modified_base (313)..(313): a, c, t, g, unknown or other
  modified_base (356)..(356): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctgganattgcctgagtgctgcctnttgacgcccacagctgaaagcagcgcctacaaactcctnatcatcggtaaccagcaatccggccctacgacggggttccccngtaccgatttctctggcctcccaacgtcacgccacctcacgtccctccctcgtcactcgctgggctccgagctgacgatcgaggctagtattagttatacgtcctacgttctattacgacaacctaccctcgtcgttcggtttgacgttcggttcggtcggacggtacgacgtcg

SEQ ID NO: 401934 - DNA, 698 bp, Homo sapiens
  misc_feature: GZ8MTXP02FSS9J.21.25.C03.1.454.CMB.2.raw
  modified_base (288)..(288): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggccctgtgcagtgagcgaggagagtgaggaggagaggagaccaggccagtgctaggagtattgtcctgagtgctgcctcttgtcgcccanagctagaagcagacgcctaccaaactcctacactctaagtacggtaaaccagtaccaacgtcccggaccctcggacgggtccctagtacccgtatttcccgtcgtacggtaccctaccgtaaacgttcccgttacggaccctaacccgtccgtaaccgtcccccgttccccgttcggtacccgtacgtcccggtcgttcgggtacccgtacccggacggtaccgtacggaaccggtagttacgggacggtacttaggttaaactttaacgttacgttacgtcgtaaaccgttcttaaacgttaccgaaaccctaaacccgtacccgtttcggtaccgggttttggtttttaaccgggtccgtttcgggttaccgggggaccggggtaccgggaaccgtaacggttcccgg

SEQ ID NO: 401935 - DNA, 573 bp, Homo sapiens
  misc_feature: GZ8MTXP02HL95F.21.25.C03.1.454.CMB.2.raw
  modified_base (280)..(280): a, c, t, g, unknown or other
  modified_base (406)..(406): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgaggcggctgcgtcagcacagactgggcccaggaccctgtgcagtgagcgaggagagtgaggaggagaggagacaggccatgctggagatgcctgagtgctgcctctgtgcccanagctgaaagcagacgcctcaaaactcctacatctaattcggaaaccaggcaaacttccgggcccttcgaacggggtccctgacccgtattccgtctggcttacccgaaagtcctggtctaaccccncacgccgtcccgtcgtcgtactcgtcgtcggtccgtccgacgtacgtacgacgagtagacggtacgtacgtagttattacgttacgtacgtacgtactactacgtactaacctaccgtacgtcgttcggtttcggtcgtcggtcggtcggtacggtaccgtacgtcg

SEQ ID NO: 401936 - DNA, 652 bp, Homo sapiens
  misc_feature: GZ8MTXP02JO6AI.21.25.C03.1.454.CMB.2.raw
  modified_base (297)..(297): a, c, t, g, unknown or other
  modified_base (341)..(341): a, c, t, g, unknown or other
  modified_base (435)..(435): a, c, t, g, unknown or other
  modified_base (441)..(441): a, c, t, g, unknown or other
tcagtcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccggagggcgctgcgtcagcacagactgggcccaggaccctgtgcagtgagcgaggagagtgaggaggagaggacgacgaggccagtgcgtggagtattcgcctagagtgctcgccttagttgccgacccagngcgtagaacgcagacgcctaccaacctctcagttcagtagaacngactacgccggtcccacggcggggtccctaggaccctacttccgtcgtcggccttaccgacgtctcggcccaccgtccgacgtccccttcccgngtaccncggtccgtcggtccgggtcctcggaagtccgtaggaaccggtagtacggacgtaccgttgttaatttaacgtttcgtacgacccgttaacgtcgttaacgacccggtaaacctaaacccgttcccgtagggtttaccggttttcggtttcgggcccgtttacgggggtcccggggtaccgggtaacccggaaccgtaacgggtttccccgg

SEQ ID NO: 401937 - DNA, 642 bp, Homo sapiens
  misc_feature: GZ8MTXP02IHLBI.21.25.C03.1.454.CMB.2.raw
  modified_base (225)..(225): a, c, t, g, unknown or other
  modified_base (233)..(233): a, c, t, g, unknown or other
  modified_base (244)..(244): a, c, t, g, unknown or other
  modified_base (256)..(256): a, c, t, g, unknown or other
  modified_base (260)..(260): a, c, t, g, unknown or other
  modified_base (262)..(262): a, c, t, g, unknown or other
  modified_base (272)..(272): a, c, t, g, unknown or other
  modified_base (418)..(418): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccgagggcgctgcgtcagcacagactgggacccagggaccctggtgcagtgagcgaggagngtgaaggngagagagaccnggcatgctggantgcngngtgctgcctntgccaccagagctagaagctaggaccgtaccctacccaaacgtcccagtactacgtaaagtaggtaacccagacctaacgtcccggaccctacggacgggttcccccagaaccgttacttccgcgtaccggctaccctaaggttcncggtacccaccgtaccgccgtacccttcccggtgtactcgtccggtcgtccggggtcctaccggacggtaccgtaggtaccgtagtcgaggtactaggttattaagtttctacgtaccgtacgtacctagtaccgaaacctaaaccgtcccgtagggtttccgtttgggtttaacgtccggttacgggttccgggaccggttacgggaacccgtaggtccccgg

SEQ ID NO: 401938 - DNA, 587 bp, Homo sapiens
  misc_feature: GZ8MTXP02HSLEE.21.25.C03.1.454.CMB.2.raw
  modified_base (245)..(245): a, c, t, g, unknown or other
  modified_base (247)..(247): a, c, t, g, unknown or other
  modified_base (253)..(253): a, c, t, g, unknown or other
  modified_base (262)..(262): a, c, t, g, unknown or other
tcagtcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctgggccccagacaccgaggcggctgcgtcagcacagactggcccaggaccctgtgcagtgagcgaggagaggagaggaggagaggagacgacgcgangngtgagngtgtcgtgngtgctcgtcctcttgtcgccacgacgcgtagaagacgacgacgacctacctaacctctactactactacgtacgtaacgacgacacgtcgcccgtcgtccggtccgtacgtaccgtacgttctcgtcgtcgtacctacgtcgtcgtcctaccgtccgtaccgtccctccgtcgtcgtacgtcgcgtcggtccgtccgtacgtcgtcgacgacgacggacgtacgtagttagttacgttacttacgtaccgtacgtactactacgtaacctacctaccgtcgttcgtttggtttcggtcgttcggtcggtccggaccggtacgacg

SEQ ID NO: 401939 - DNA, 679 bp, Homo sapiens
  misc_feature: GZ8MTXP02IFOKK.21.25.C03.1.454.CMB.2.raw
tcagtcgtcgctcgcacgaccggtgctcgatttagtagtgtagatttgggtttgggggctgttcctggaagttgctgataccagtgcacagtcaaaaggtgacccgatgttggagctgctcccagcgcaggagatggtgaccgtctgccctggggccccagacaccgagggcggctgcgtcagcacagactgggcccagggaccctgtgcagtgagcgaggagagtgaggaggagaggagaccaggccatgctggagattgctgagtgctgcctcttgtcgccccacgagctgaagcagacgcctacccaaactcctcatctatacggtaaccagactaaacgtccggcccttcgacggggttcccctcgaccgtaactttcctcgtcgggaccttccgtaaagtccttacggcccaacccgttacgacgtccccgttcccgtacggtcctaactccggcgttacggggcccttacggacggtctacggacgtacgtcggtacggacttacggtatttacgttaagttcgtaccctaacggttcctaacgtacggtaaaccctaaacctaaccccgttacgggtaccgttttacggggtttttaacgggtaccggttttaccgggttccgggggttacccgggggaaccggggttaacccggaaaacggtttaccccgg

SEQ ID NO: 401940 - DNA, 613 bp, Homo sapiens
  misc_feature: GZ8MTXP02FSQHN.21.25.C03.1.454.CMB.2.raw
  modified_base (227)..(227): a, c, t, g, unknown or other
  modified_base (268)..(268): a, c, t, g, unknown or other
  modified_base (284)..(284): a, c, t, g, unknown or other
  modified_base (508)..(508): a, c, t, g, unknown or other
  modified_base (516)..(516): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccagcgcaggagatggtgaccgtctgccctggggccccagacaccggagggcgctgcgtcagcacagactgggcccaggaccctgtgcagtgacggcgaggagagngaagggaggagaggacgacaggccagtgcgtggatatgtcngagtgctgcctcgttncgaccagagcgtagagcagacgccctaaccgaaactctactatctaataggtaaaccagacctaaacgtcccggaccctaccggacggggttcccctacgtaccgttactttccctggtaccgaccttaccgtaagtccgttacgaccctaccgtacgaccgtcccctcccggtcgttcgacgtcccgtcggttcgggcccgtacgacggcgtaggacgtaagnggtaacgngtattagttatacgtcaccagttaccagtctaacctaacgtcccgttaggtcgttttacggttggtcgttcggtcgggtcgacggtaacctggtccg

SEQ ID NO: 401941 - DNA, 572 bp, Homo sapiens
  misc_feature: GZ8MTXP02I9C1Q.21.25.C03.1.454.CMB.2.raw
  modified_base (281)..(281): a, c, t, g, unknown or other
  modified_base (292)..(292): a, c, t, g, unknown or other
  modified_base (305)..(305): a, c, t, g, unknown or other
  modified_base (452)..(452): a, c, t, g, unknown or other
  modified_base (500)..(500): a, c, t, g, unknown or other
  modified_base (513)..(513): a, c, t, g, unknown or other
tcagtcgtcgctcgcacgaccggtgctcgatttagtagtgtagatttgggtttgggggctgttcctggaagttgctgataccagtgcacatcaaaaaggtgacccgatgttggagctgctcccaacgcaggagatggtgaccgtctgccctggggccccagacaccgagggcggctgcgtcagcacagactgggcccaggaccctgtgcagtgagcgaggagagtgaggaggagaggagaccgaggccatgctggagtattcgtctgtagtcgctgtcctnttgcgccccanagctagagcagcncctaccaaactcctacgatactatacggtaacacgacctaacgtccggccccttggaaccggggttcccctaggaccgtactttccgtccgtaggtccctaaccgagtaccgtcggacccaccttccgacgtcccctccgtggtacncgtcgcgtacggtcctcgaggcctaggctagtgagctagtattacttntacgcaattccanagaaacctacgtccgtgtacggttttgtgcgttgtcggcggacgtacacggtctaccgg

SEQ ID NO: 401942 - DNA, 490 bp, Homo sapiens
  misc_feature: GZ8MTXP01D9DHD.4.37.D04.1.454.CMB.2.raw
  modified_base (359)..(359): a, c, t, g, unknown or other
  modified_base (478)..(478): a, c, t, g, unknown or other
  modified_base (486)..(486): a, c, t, g, unknown or other
  modified_base (489)..(489): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatggggatggactcggacctaacgagcggtggcaacaaagtntgcacagaagtttcagggcagggtcacatgaccagggacacgtcatcagcacggtccatcagcacagcctacatggacctgagcggccttgacagtctgacgcacggccgtataattcngttggcgnggng

SEQ ID NO: 401943 - DNA, 535 bp, Homo sapiens
  misc_feature: GZ8MTXP01D52HY.4.37.D04.1.454.CMB.2.raw
  modified_base (254)..(254): a, c, t, g, unknown or other
  modified_base (353)..(353): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttcnggatacaccttcaccgcctactatatgcacgtgggtgcgacgtcggcccctaggacgaagggctttggagtggatggggatggactccgaacctaacgnggcggtaggacaacgaaagtatgacaacgaggtaaagtttcgagggcagggtcaccgatagaccgagggacacgtcatcagcacggtcatcagcacacgacctacagtcggacctgacggcggcttggacagtcgtacgacgacgacggccgtataagtttcgtgttggtcggaagggtaag

SEQ ID NO: 401944 - DNA, 491 bp, Homo sapiens
  misc_feature: GZ8MTXP01CLDVN.4.37.D04.1.454.CMB.2.raw
  modified_base (341)..(341): a, c, t, g, unknown or other
  modified_base (459)..(459): a, c, t, g, unknown or other
  modified_base (480)..(480): a, c, t, g, unknown or other
  modified_base (487)..(487): a, c, t, g, unknown or other
  modified_base (490)..(490): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccgcctactatatgcactgggtgcgactggccccctggacaagggcttgagtggatgggatggactcggacctaanagcggtaggcaacaaagtatgcacagaagttcagggcagggtcacatgaccagggacacgtcatcagcacggtcatcagcacagcctacatggacctggacgcggccttggacagtcngacgcacgcgtataatttcgngttgcgnggng

SEQ ID NO: 401945 - DNA, 493 bp, Homo sapiens
  misc_feature: GZ8MTXP01E5FV8.4.37.D04.1.454.CMB.2.raw
  modified_base (460)..(460): a, c, t, g, unknown or other
  modified_base (487)..(487): a, c, t, g, unknown or other
  modified_base (489)..(489): a, c, t, g, unknown or other
  modified_base (492)..(492): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctgggggcctcagtgaaggtctcctgcaaggcttctggatacaccttcaccgcctactatatgcactgggtgcgactggccccctggacaagggcttgagtggatgggatggatcgacctaacagcggtaggcaacaaagtatgcacagaaagtttcagggcagggtcacatgaccagggacacgtccatcagcacggtcaatcagcacagcctacatggacctgagcggccttggacagtcngacgacacggccgtataattctgttgngnggng

SEQ ID NO: 401946 - DNA, 494 bp, Homo sapiens
  misc_feature: GZ8MTXP01D9T6P.4.37.D04.1.454.CMB.2.raw
  modified_base (358)..(358): a, c, t, g, unknown or other
  modified_base (462)..(462): a, c, t, g, unknown or other
  modified_base (490)..(490): a, c, t, g, unknown or other
  modified_base (493)..(493): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacaagggctttgagtggatgggatggactcgacctaagagcggtgcaacaaagtntgcacagaagtttcagggcagggtcacatgaccgagggacacgtcatcagcacggtcatcagcacacgcctacagtcggacctggacgcggcttggacagtcgngacgcgacgccgtatcttctgttgtcgnggng

SEQ ID NO: 401947 - DNA, 511 bp, Homo sapiens
  misc_feature: GZ8MTXP01B175C.4.37.D04.1.454.CMB.2.raw
  modified_base (226)..(226): a, c, t, g, unknown or other
  modified_base (486)..(486): a, c, t, g, unknown or other
  modified_base (496)..(496): a, c, t, g, unknown or other
  modified_base (500)..(500): a, c, t, g, unknown or other
  modified_base (502)..(502): a, c, t, g, unknown or other
  modified_base (504)..(504): a, c, t, g, unknown or other
  modified_base (506)..(506): a, c, t, g, unknown or other
  modified_base (508)..(508): a, c, t, g, unknown or other
  modified_base (510)..(510): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccgcctactatatgcacgtgggtgcgactcggccccctggacaagggcttgagtggatggggatggactccggacctaagaggcggtaggacaacgaaaagtatggacaacgaaggaaagtttcgagggcagggtcaccatgaccgagggacacgcatcagcacggtcatcagcacacgcctaacagtcggaccctggacggcgggccttgggacaaggcgngacgcgcggntatntngngngngng

SEQ ID NO: 401948 - DNA, 514 bp, Homo sapiens
  misc_feature: GZ8MTXP01CF5FN.4.37.D04.1.454.CMB.2.raw
  modified_base (446)..(446): a, c, t, g, unknown or other
  modified_base (501)..(501): a, c, t, g, unknown or other
  modified_base (508)..(508): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacagggcttgagtggatgggatggactccgacctaagagcggtggcaacaaagtatgcacgagaagtttcgaggggtcagggtcaccgagtcgaccgaggggacacggtccatcagccacggtccatcagccacacgcctacntcggacctgacggcggcgttggaccgagtccgtgacgcgacggccgtatcttcgngttgcgngggaag

SEQ ID NO: 401949 - DNA, 496 bp, Homo sapiens
  misc_feature: GZ8MTXP01EOHY9.4.37.D04.1.454.CMB.2.raw
  modified_base (223)..(223): a, c, t, g, unknown or other
  modified_base (465)..(465): a, c, t, g, unknown or other
  modified_base (492)..(492): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggctnagtgagtctctgcaggcttctggatacaccttcaccgcctactatatgcactgggtgcgactggcccctggacaagggctttggagtggatgggatggactccgacctaagagcggtagacaacgaaagtatgacaacgagtaagtttcgagggcagggtcacatgacgagggacacgtcatcagcacggtcatcacgcacacgacctacacgtggacctggacgcgggccttggacagtcngacgcacggctataattctgttggtgnggng

SEQ ID NO: 401950 - DNA, 488 bp, Homo sapiens
  misc_feature: GZ8MTXP01DZCF2.4.37.D04.1.454.CMB.2.raw
  modified_base (222)..(222): a, c, t, g, unknown or other
  modified_base (332)..(332): a, c, t, g, unknown or other
  modified_base (475)..(475): a, c, t, g, unknown or other
  modified_base (482)..(482): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggctnagtgagtctctgcaaggctctggatacaccttcaccgcctactatatgcacgtgggtgcgactcggcccctggacagggctttgagtggatgggatggactcgacctaangcggtagcaacaaagtatgcacagaaagtttcagggcagggtcaccatcgacgagggacacgccatcagcacggtccagtcacgcacagacctacatcggacctgacgcggccttgaccatctgacgacacggctataattcngttgcgngggaag

SEQ ID NO: 401951 - DNA, 565 bp, Homo sapiens
  misc_feature: GZ8MTXP01CSRS1.4.37.D04.1.454.CMB.2.raw
  modified_base (531)..(531): a, c, t, g, unknown or other
  modified_base (547)..(547): a, c, t, g, unknown or other
  modified_base (551)..(552): a, c, t, g, unknown or other
  modified_base (554)..(554): a, c, t, g, unknown or other
  modified_base (556)..(556): a, c, t, g, unknown or other
  modified_base (558)..(558): a, c, t, g, unknown or other
  modified_base (560)..(560): a, c, t, g, unknown or other
  modified_base (562)..(562): a, c, t, g, unknown or other
  modified_base (564)..(564): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactggccccctggacaagggcttgagtggatgggatggactccggaacctagaggcgggtagggacaacgaaaagtatacggacaaccgaagtaaaggtttccgaagggggtaccagggggtaccaaccgagtacggaacccgaaggggaccaccggtacccaatccaaggccaacggggttcccaattccaaggccaaccgagccctaacgaacgtcggaaccctgacgggcgggaccgnggacgaggcgcgacgngcgnntntngngngngng

SEQ ID NO: 401952 - DNA, 457 bp, Homo sapiens
  misc_feature: GZ8MTXP01AFAYJ.4.37.D04.1.454.CMB.2.raw
  modified_base (223)..(223): a, c, t, g, unknown or other
  modified_base (232)..(232): a, c, t, g, unknown or other
  modified_base (241)..(241): a, c, t, g, unknown or other
  modified_base (243)..(243): a, c, t, g, unknown or other
  modified_base (246)..(246): a, c, t, g, unknown or other
  modified_base (249)..(249): a, c, t, g, unknown or other
  modified_base (251)..(251): a, c, t, g, unknown or other
  modified_base (256)..(260): a, c, t, g, unknown or other
  modified_base (262)..(262): a, c, t, g, unknown or other
  modified_base (264)..(265): a, c, t, g, unknown or other
  modified_base (401)..(401): a, c, t, g, unknown or other
  modified_base (443)..(443): a, c, t, g, unknown or other
  modified_base (448)..(448): a, c, t, g, unknown or other
  modified_base (450)..(450): a, c, t, g, unknown or other
  modified_base (452)..(452): a, c, t, g, unknown or other
  modified_base (454)..(454): a, c, t, g, unknown or other
  modified_base (456)..(456): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctnagtgagtcnctgcagctngntcnctncncatannnnngncnngcctgacaggctgagtgatggatggactcgacctaagagcggtgacaacaaagtatgacacaggtagtttcagggtcgagggtcaccgatgaccgagggacacgtcatacagcacggtcatcacgcacagcctacntcggacctgacgcgcttggacagtcgacgacgcgacgctatnttcgngngngngng

SEQ ID NO: 401953 - DNA, 505 bp, Homo sapiens
  misc_feature: GZ8MTXP01EL39S.4.37.D04.1.454.CMB.2.raw
  modified_base (226)..(226): a, c, t, g, unknown or other
  modified_base (443)..(443): a, c, t, g, unknown or other
  modified_base (494)..(494): a, c, t, g, unknown or other
  modified_base (496)..(496): a, c, t, g, unknown or other
  modified_base (500)..(500): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccgcctactatatgcactgggtgcgactggcccctggacagggcttgagtggatgggatgggactccggaacctaacgagcggtaggacaacaaaagtatgacaacgaggaagtttcgaggggcagggtcaccatgaccagggacacgtcatcagcacggtcatcagcacacgcctacntcggacctggagcggcttggacacgtcgacgacgacgcggctataattcgngngtgnggaag

SEQ ID NO: 401954 - DNA, 524 bp, Homo sapiens
  misc_feature: GZ8MTXP01ELM9D.4.37.D04.1.454.CMB.2.raw
  modified_base (223)..(223): a, c, t, g, unknown or other
  modified_base (243)..(243): a, c, t, g, unknown or other
  modified_base (333)..(333): a, c, t, g, unknown or other
  modified_base (354)..(354): a, c, t, g, unknown or other
  modified_base (407)..(407): a, c, t, g, unknown or other
  modified_base (418)..(418): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctnagtgagtctctgcaggctcngatacactcaccgctactatatgcacgtgggtgcgactcggcccctaggacaagggcttggagtggatgggatggactccggacctaagnggcggtagacaacgaaagtanacgacacgagtagttcgagggcgaggtacacgagtacgacgaggacacgacancagcacgtcancacgacacacgacctacacgtcgaccgtcggacggccggcgttagacacgtcgtacggacgacgaccggtaactagttcgttcgtggttacgtcgggaagggtaag

SEQ ID NO: 401955 - DNA, 528 bp, Homo sapiens
  misc_feature: GZ8MTXP01D2OAB.4.37.D04.1.454.CMB.2.raw
  modified_base (225)..(225): a, c, t, g, unknown or other
  modified_base (347)..(347): a, c, t, g, unknown or other
  modified_base (365)..(365): a, c, t, g, unknown or other
  modified_base (518)..(518): a, c, t, g, unknown or other
  modified_base (521)..(521): a, c, t, g, unknown or other
  modified_base (525)..(525): a, c, t, g, unknown or other
  modified_base (527)..(527): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcatctggtgcagtctggggctgaggtgaagaagctggggcctnagtgaaggtctcctgcaaggcttctggatacaccttcaccgcctaactatatgcacgtgggtgcgacttcggcccctgggaccaagggctttggagtggatgggatggactcggacctaagngcggtagacaacaaagtntgcacgagtaagtttcgagggcagggtacacgatacgaccgaggacgacgtacacgtcacgacgacggtaccacgtacacgaccaacacgacctaacgactcggaccgtggaggcggccgttggacgacgtcgtagacgacgacgcagttctntgngtgngng

SEQ ID NO: 401956 - DNA, 471 bp, Homo sapiens
  misc_feature: GZ8MTXP01A9GMX.4.37.D04.1.454.CMB.2.raw
  modified_base (333)..(333): a, c, t, g, unknown or other
  modified_base (420)..(420): a, c, t, g, unknown or other
  modified_base (458)..(458): a, c, t, g, unknown or other
  modified_base (461)..(466): a, c, t, g, unknown or other
  modified_base (468)..(468): a, c, t, g, unknown or other
  modified_base (470)..(470): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacagggcttgagtgatggatggatcgacctanagcggtgcaacaaagtatgcacgagaaagtttcagggcagggtcaccatgaccgagggacacgtccatcagcacggtcatcagcacngcctacatgacctgagcggcttggcagcgcagttacgngcnnnnnngngng

SEQ ID NO: 401957 - DNA, 489 bp, Homo sapiens
  misc_feature: GZ8MTXP01D9OGJ.4.37.D04.1.454.CMB.2.raw
  modified_base (226)..(226): a, c, t, g, unknown or other
  modified_base (246)..(246): a, c, t, g, unknown or other
  modified_base (337)..(337): a, c, t, g, unknown or other
  modified_base (346)..(346): a, c, t, g, unknown or other
  modified_base (352)..(352): a, c, t, g, unknown or other
  modified_base (461)..(461): a, c, t, g, unknown or other
  modified_base (477)..(477): a, c, t, g, unknown or other
  modified_base (482)..(482): a, c, t, g, unknown or other
  modified_base (484)..(484): a, c, t, g, unknown or other
  modified_base (486)..(486): a, c, t, g, unknown or other
  modified_base (488)..(488): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaagtctctgcaggctntggatacaccttcaccgcctactatatgcacgtgggtgcgactcggccccctggacaaggggcttggagtgatgggatggactcgacctangcgtgcaanaaagtngcaacagaaagtttcagggcagggtcaccatagaccgaagggacacgtcatcagcacggtcatcagcacacgacctacagtggacctgaggcggcttgggacaaggccncgacgcgacggccatntgtgngngngng

SEQ ID NO: 401958 - DNA, 491 bp, Homo sapiens
  misc_feature: GZ8MTXP01APRE1.4.37.D04.1.454.CMB.2.raw
  modified_base (339)..(339): a, c, t, g, unknown or other
  modified_base (356)..(356): a, c, t, g, unknown or other
  modified_base (423)..(423): a, c, t, g, unknown or other
  modified_base (457)..(457): a, c, t, g, unknown or other
  modified_base (480)..(480): a, c, t, g, unknown or other
  modified_base (487)..(487): a, c, t, g, unknown or other
  modified_base (490)..(490): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctgggggcctcagtgaaggtctcctgcaaggcttctggatacaccttcaccgcctactatatgcactgggtgcgactggcccctggacaagggcttggagtggatgggatggatcgacctaanagcggtgcaacaaagtntgcacagaagtttcagggcagggtcaccatgaccgagggacacgtcatcagcacggtcatcagcacncgcctacatggacctgagcggccttggacagtcngacgcacggcgtataactttcgngttgcgnggng

SEQ ID NO: 401959 - DNA, 570 bp, Homo sapiens
  misc_feature: GZ8MTXP01DGV8U.4.37.D04.1.454.CMB.2.raw
  modified_base (252)..(252): a, c, t, g, unknown or other
  modified_base (556)..(557): a, c, t, g, unknown or other
  modified_base (560)..(561): a, c, t, g, unknown or other
  modified_base (563)..(563): a, c, t, g, unknown or other
  modified_base (565)..(565): a, c, t, g, unknown or other
  modified_base (567)..(567): a, c, t, g, unknown or other
  modified_base (569)..(569): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctctgcaggtcttcnggatacaccttcaccgcctaactatatgcacgtgggtgcgacgtcggcccctaggaccgaaggggtctttaggaggtggagtggggatggactaccggacctaagaggcggtaaggacaacgaaagtgtagacaacgaaggtaacggtttcgacgggacgaaggggtccaaccgtagtacggaaaccgacggggaaccaccggtaccactacgacgaccacgggtaccagtacacgacacgacgacctaagcgtacggaaccgtggacggccgggcgttcgggacgacggcgcaacgttacgcnntgnngngngngng

SEQ ID NO: 401960 - DNA, 497 bp, Homo sapiens
  misc_feature: GZ8MTXP01DPVIH.4.37.D04.1.454.CMB.2.raw
  modified_base (225)..(225): a, c, t, g, unknown or other
  modified_base (435)..(435): a, c, t, g, unknown or other
  modified_base (443)..(443): a, c, t, g, unknown or other
  modified_base (479)..(479): a, c, t, g, unknown or other
  modified_base (486)..(486): a, c, t, g, unknown or other
  modified_base (488)..(488): a, c, t, g, unknown or other
  modified_base (490)..(490): a, c, t, g, unknown or other
  modified_base (492)..(492): a, c, t, g, unknown or other
  modified_base (494)..(494): a, c, t, g, unknown or other
  modified_base (496)..(496): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaggcttctggatacaccttcaccgcctactatatgcacgtgggtgcgactcggcccctggacaagggcttgagtggatggatggactcgacctagagcggtaggacaacgaaagtatagacaacgagtaagtttcgagggcgagggtcacagtcgaacgagggacacgtccatcagcacggtccatcagcaacncgacctanagtcggacctgacgcggcttgaccagtcgcgacgcncgctatntngngngngng

SEQ ID NO: 401961 - DNA, 541 bp, Homo sapiens
  misc_feature: GZ8MTXP01C923F.4.37.D04.1.454.CMB.2.raw
  modified_base (373)..(373): a, c, t, g, unknown or other
  modified_base (527)..(527): a, c, t, g, unknown or other
  modified_base (532)..(532): a, c, t, g, unknown or other
  modified_base (534)..(534): a, c, t, g, unknown or other
  modified_base (536)..(536): a, c, t, g, unknown or other
  modified_base (538)..(538): a, c, t, g, unknown or other
  modified_base (540)..(540): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctctgcaaggcttctgatacaccttcaccgcctactatatgcacgtgggtgcgacgtcggcccctggacgaagggtctttaggaggtggagtggggatgggactccggaacctaagaggcggtaggacaacgaaagtntgacaacgtaggtaaacgtttcgagggcagggtcacgagtacgaccgagggacacgtccatcaagccacgggtacccagtacacgaccaccgacgacctaacagtcggaccctggacgcggccttggaccagtcgcgacgttacgcggtctatnttcgngngngngng

SEQ ID NO: 401962 - DNA, 575 bp, Homo sapiens
  misc_feature: GZ8MTXP01B3ISZ.4.37.D04.1.454.CMB.2.raw
  modified_base (548)..(548): a, c, t, g, unknown or other
  modified_base (564)..(564): a, c, t, g, unknown or other
  modified_base (566)..(566): a, c, t, g, unknown or other
  modified_base (571)..(571): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaaggtctcctgacaaggcttcgtggataccaccttcacccgcctactatatcgcacgtggggtcgccgacgtcggccccctaggaccgaaggggtctttgaaggtggatgggatggactccgactaagaggcggtaggacaacgaaagtatcgacaacgagggtaaacgtttccgaaggggccaaggggtaccaccgagtacgaacccgagggaccacggtacagtacgagaccgacgggtacccataccgagaccacgacgacctacagtcggaaccctggaacgccggcttacgggacagtccgacgacgacncgaacgtataattcgngngtcgngaag

SEQ ID NO: 401963 - DNA, 499 bp, Homo sapiens
  misc_feature: GZ8MTXP01B2F0B.4.37.D04.1.454.CMB.2.raw
  modified_base (339)..(339): a, c, t, g, unknown or other
  modified_base (357)..(357): a, c, t, g, unknown or other
  modified_base (460)..(460): a, c, t, g, unknown or other
  modified_base (478)..(478): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactggcccctggacagggcttgagtggatgggatggactcgacctaagngcggtggcaacgaaagtntgcacgagtaagtttcagggcagggtcaccatgaaccgagggacacgtcatcagcacggtcatcagcacacgcctacatgacctgagcggcttggacagtcgngacgcgacggtccgtatnttctggttgcggaagggaagg

SEQ ID NO: 401964 - DNA, 481 bp, Homo sapiens
  misc_feature: GZ8MTXP01BGY3E.4.37.D04.1.454.CMB.2.raw
  modified_base (222)..(222): a, c, t, g, unknown or other
  modified_base (242)..(242): a, c, t, g, unknown or other
  modified_base (251)..(251): a, c, t, g, unknown or other
  modified_base (271)..(271): a, c, t, g, unknown or other
  modified_base (319)..(319): a, c, t, g, unknown or other
  modified_base (340)..(340): a, c, t, g, unknown or other
  modified_base (465)..(465): a, c, t, g, unknown or other
  modified_base (470)..(470): a, c, t, g, unknown or other
  modified_base (472)..(479): a, c, t, g, unknown or other
  modified_base (481)..(481): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgagtgaagagctggggctnagtgagtctctgcaggctcngatacactnacgctatatatgcatgggtncgactggcccctggacagggcttgagtgatggatggactcgacctagngtcggtagacaacgtaaagtntagacacgagtaagttcgaagggcagggtcaccgagtgaccgagggaccagtccatcagccacgggtcagtcacgcaacgacgacctaacgatcggacctggacgcgggcttgggccaaggccgnttagngnnnnnnnngn

SEQ ID NO: 401965 - DNA, 512 bp, Homo sapiens
  misc_feature: GZ8MTXP01DIQQE.4.37.D04.1.454.CMB.2.raw
  modified_base (229)..(229): a, c, t, g, unknown or other
  modified_base (347)..(347): a, c, t, g, unknown or other
  modified_base (368)..(368): a, c, t, g, unknown or other
  modified_base (481)..(481): a, c, t, g, unknown or other
  modified_base (501)..(501): a, c, t, g, unknown or other
  modified_base (508)..(508): a, c, t, g, unknown or other
  modified_base (511)..(511): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctctgcaaggcttctggatacaccttcaccgcctactatatgcacgtgggtgcgactcggcccctggacaagggctttggagtggatggggatggactccgacctaagnggcggtaggacaacgaaagtntgacacgagtaagtttcgagggcagggtcacgatcgaacgagggacacgtcatcagcacggtcatcacgcacacgacctacacgtcggacctggacgcggcttggacagtcgngacgcgacgcgtatcttcgngcgcggnggng

SEQ ID NO: 401966 - DNA, 490 bp, Homo sapiens
  misc_feature: GZ8MTXP01AX87J.4.37.D04.1.454.CMB.2.raw
  modified_base (364)..(364): a, c, t, g, unknown or other
  modified_base (442)..(442): a, c, t, g, unknown or other
  modified_base (450)..(450): a, c, t, g, unknown or other
  modified_base (465)..(465): a, c, t, g, unknown or other
  modified_base (470)..(470): a, c, t, g, unknown or other
  modified_base (479)..(479): a, c, t, g, unknown or other
  modified_base (481)..(481): a, c, t, g, unknown or other
  modified_base (483)..(483): a, c, t, g, unknown or other
  modified_base (485)..(485): a, c, t, g, unknown or other
  modified_base (487)..(487): a, c, t, g, unknown or other
  modified_base (489)..(489): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacacccttcaccgcctactatatgcacgtgggtgcgactcggccccctggacaagggcttggagtggatgggatggactccgacctaagagcggtggacaacgaaagtntgacacgagtaagtttcgagggcagggtcacgatgaaccgagggacacgtcatcagcacggtcatcagcacagctacntgacctgngcggcttgcagtcgngacgnacgcgtatntngngngngng

SEQ ID NO: 401967 - DNA, 566 bp, Homo sapiens
  misc_feature: GZ8MTXP01BORY6.4.37.D04.1.454.CMB.2.raw
  modified_base (224)..(224): a, c, t, g, unknown or other
  modified_base (233)..(233): a, c, t, g, unknown or other
  modified_base (243)..(243): a, c, t, g, unknown or other
  modified_base (524)..(524): a, c, t, g, unknown or other
  modified_base (551)..(551): a, c, t, g, unknown or other
  modified_base (560)..(560): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggctnagtgagtcnctgcagctcngatacacctcaccgcctactatatgcagtgggtcgcgacgtcggcccctggacgaagggctttggagtgagtggatggactccgaacctaagagcggtaggacaacgaaagtatcgacaacgaaggtaagtttcgaagggcgaaggggtaccaaccgaagtcggaacccgaaggggaacaaccgtaccaagtcaaacgccaaccggggtaccaagtaccacgccaacgacgacctaacgacgtcggaaccctggacggccgggccaggaccttagtaccgngaacgcgaccgtaacgtataattcggngacgtcggnggtaag

SEQ ID NO: 401968 - DNA, 548 bp, Homo sapiens
  misc_feature: GZ8MTXP01A99XA.4.37.D04.1.454.CMB.2.raw
  modified_base (511)..(511): a, c, t, g, unknown or other
tcagagcactgtagcacgaccggtgctcgatttagtagcatactgttgggtttgggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactggtccgccaggctccaggcaagggctggaatgggtgcagttatatggtttgatggaaactaacaaattctatgcagactccgtgaagggccgattcaccatctccagagacaatttcgagaacacattgaatctaacagatgaacagtctgagaagccgaagacacgggctgtctattattgtgcgagagtaagtggtcagtgtctttgacagtgggcgacgggaccgtggtcaccgtctcctcgagccttaccaccgaacggggtcccctaagtccggtcccttcccccgttggcccgcccgtcgccttccgnggacgccaccgtcgtcgggggcaccgcggccggcccg

SEQ ID NO: 401969 - DNA, 553 bp, Homo sapiens
  misc_feature: GZ8MTXP01BWSV9.4.37.D04.1.454.CMB.2.raw
  modified_base (343)..(343): a, c, t, g, unknown or other
  modified_base (364)..(364): a, c, t, g, unknown or other
  modified_base (552)..(552): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttctggatacaccttcaccgcctactatatgcacgtgggtgcgactcggcccctggacaagggcttgaggtggagtggatggactccgacctaagnggcggtaggacaacgaaagtntagcacgagtaagtttcgagggcgagggtcaccgatcggaaccgaggggacaccggtacactcacgccacgggtccaagtcacgaccacacgacctaacgacgtccgggaccctggaacggccgggcgttacggaccgaacgtccggtcgaacgcgacggtctagtaatttcgagttgaacgaagggng

SEQ ID NO: 401970 - DNA, 524 bp, Homo sapiens
  misc_feature: GZ8MTXP01A8K9G.4.37.D04.1.454.CMB.2.raw
  modified_base (225)..(225): a, c, t, g, unknown or other
  modified_base (286)..(286): a, c, t, g, unknown or other
  modified_base (341)..(341): a, c, t, g, unknown or other
  modified_base (359)..(359): a, c, t, g, unknown or other
  modified_base (511)..(511): a, c, t, g, unknown or other
  modified_base (520)..(520): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaggtctcctgcaaggcttctggatacaccttcaccgcctactatatgcacgtgggtncgactggcccctggacaaggggcttggagtggatgggatggactcggacctaagngcggtgacaacgaaagtntgacacgagtagtttcagggtcagggtacacatcgacagggacacgtcagtcagcacggtcatcgacgtcacgacgcctaacgcgtcggacccttggaacggtccggccttagggacacgtccgtacgacgcgcggtaacgtatcgtttcgngttcgtcgnggng

SEQ ID NO: 401971 - DNA, 503 bp, Homo sapiens
  misc_feature: GZ8MTXP01AGVRE.4.37.D04.1.454.CMB.2.raw
  modified_base (226)..(226): a, c, t, g, unknown or other
  modified_base (355)..(355): a, c, t, g, unknown or other
  modified_base (493)..(493): a, c, t, g, unknown or other
  modified_base (495)..(495): a, c, t, g, unknown or other
  modified_base (497)..(497): a, c, t, g, unknown or other
  modified_base (499)..(499): a, c, t, g, unknown or other
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccgcctactatatgcacgtgggtgcgactcggcccctggacagggcttgagtggatgggatggatcgactaagagcgtagacaacaaagtntgacacgagaagtttcgagggtcgagggtcaaccgagtacgaccgagggacacgtccatcagcacggtcatcacgcacagcctaacactcggaacctgcggcggcttggacagtcgacgacgcgacgcgtattctcgngngngnggng

SEQ ID NO: 401972 - DNA, 572 bp, Homo sapiens
  misc_feature: GZ8MTXP01C4MXL.4.37.D04.1.454.CMB.2.raw
  modified_base (378)..(378): a, c, t, g, unknown or other
  modified_base (557)..(557): a, c, t, g, unknown or other
  modified_base (559)..(559): a, c, t, g, unknown or other
  modified_base (566)..(566): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaggtcttcgtggactaccaccttcacccgtcctactatatgctacgtgggtcgccgacgtcggccccgtggacgagggtcttggagtggagtgggatggactccgacctagaggcggtagacaacgaaagtntgacacgagtaagttcgagggcgagggtacacgagtacgacgagggaccacgtaccagtacgacgccacggtccagtaccgacgaccaaccgacgtaccctaacgacgtcgggaacccgtcgggacggccgggtaccgttcgggaaccagtccgtacgaacgcgacggtcgtatcttgngnggtcggnggtaag

SEQ ID NO: 401973 - DNA, 583 bp, Homo sapiens
  misc_feature: GZ8MTXP01AZRK8.4.37.D04.1.454.CMB.2.raw
  modified_base (255)..(255): a, c, t, g, unknown or other
  modified_base (372)..(372): a, c, t, g, unknown or other
  modified_base (557)..(557): a, c, t, g, unknown or other
  modified_base (566)..(566): a, c, t, g, unknown or other
  modified_base (569)..(569): a, c, t, g, unknown or other
  modified_base (577)..(577): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctcctgcaggcttcnggatacacctcaccgcctactatatcgcacgtgggtgcgacgtcggcccctgggacaaggggtcttggaggtggagtgggatggactccgacctagaggcggtagacaacgaaagtngacgaggagtaagtttcgagggcgagggtacacgtagtacgaaccgacggggaccaccggtaccacgtacgacgaccgacgggtaccacgtacgacgaccacgacgaccctaacgcgttacgggaaccctgggaacggtccgggccgttacggacgacgtaccgacgaacgacgaccgtaacgtntaagttcgnggngtaacggnggtaag

SEQ ID NO: 401974 - DNA, 514 bp, Homo sapiens
  misc_feature: GZ8MTXP01EGVLX.4.37.D04.1.454.CMB.2.raw
  modified_base (225)..(225): a, c, t, g, unknown or other
  modified_base (349)..(349): a, c, t, g, unknown or other
  modified_base (480)..(480): a, c, t, g, unknown or other
  modified_base (503)..(503): a, c, t, g, unknown or other
  modified_base (505)..(505): a, c, t, g, unknown or other
  modified_base (510)..(510): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagctggggcctnagtgaggtctctgcaggctctggatacaccttcaccgcctaactatatgcacgtgggtcgcgactcggccccctaggaccgaaggggtctttggaggtggatggggatggactccgacctaagngcggtaggacaacgaaagtatgacaacgagtaagtttcgagggcagggtcacgatagaccgagggacacgtcatcagcacggtcatcagcacgacacctacagtcgacctcgaggcggcttggacaagtcncgacgacgacggctataattggngngcggnggng

SEQ ID NO: 401975 - DNA, 546 bp, Homo sapiens
  misc_feature: GZ8MTXP01CGQPH.4.37.D04.1.454.CMB.2.raw
  modified_base (476)..(476): a, c, t, g, unknown or other
  modified_base (530)..(530): a, c, t, g, unknown or other
  modified_base (536)..(536): a, c, t, g, unknown or other
  modified_base (539)..(539): a, c, t, g, unknown or other
  modified_base (541)..(541): a, c, t, g, unknown or other
  modified_base (543)..(543): a, c, t, g, unknown or other
  modified_base (545)..(545): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctggaggtgaagaagccgtggggcctgagtgaaggtctcctgcaaggcttcgtggatacaccttcacccgcctactatatcgctacgtgggtgcgacgtcggcccctggacagggtcttggagtggagtgggatggactcgacctaagacggcggtagacaacaaagtatggacaacgaggtaaagtttcgagggcgagggtacaccgagtcggaaccgaggggaccacgtacccatacgagccaacggtcagtcgacgcaacacgacctaacncgtcggaccgtggacggccgggtcgttcgggacacggtacgcgacgcgacggtntgtgtntgngngngng

SEQ ID NO: 401976 - DNA, 557 bp, Homo sapiens
  misc_feature: GZ8MTXP01D7T1O.4.37.D04.1.454.CMB.2.raw
  modified_base (230)..(230): a, c, t, g, unknown or other
  modified_base (254)..(254): a, c, t, g, unknown or other
  modified_base (375)..(375): a, c, t, g, unknown or other
  modified_base (464)..(464): a, c, t, g, unknown or other
  modified_base (540)..(540): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggggctggaggtgaagaagccgtggggcctnagtgaaggtctcctgcaggcttcnggatacaccttcaccgcctactatatgcagtgggtgcgacgtcggcccctaggacgaagggtcttggaggtggagtggggatggactccggaacctaagcggcgggtagacaacgaaagtntcgacaacgaggtaaagtttcgaggggtacgagggtcacgagtacgaaccgagggaccacggtccatcgagccacggtcatcaagcacncgacctagacgtcggacctggacggcggcgttgacttacgtcgacgaccgacgacggtccgttattcgtttacggnggagtcgggaaggtaag

SEQ ID NO: 401977 - DNA, 547 bp, Homo sapiens
  misc_feature: GZ8MTXP01DCK0Z.4.37.D04.1.454.CMB.2.raw
  modified_base (228)..(228): a, c, t, g, unknown or other
  modified_base (253)..(253): a, c, t, g, unknown or other
  modified_base (536)..(536): a, c, t, g, unknown or other
  modified_base (538)..(538): a, c, t, g, unknown or other
  modified_base (540)..(540): a, c, t, g, unknown or other
  modified_base (542)..(542): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctcctgcaaggcttcnggatacaccttcaccgcctactatatgcacgtgggtcgcgacgtcggccccctaggacgaaggggtctttggaggttggatggggatggactccgacctaagagcggtagacaacaaagtatacggacacgaagtaagttcgagggcgagggtcaaccagtacgaaccgaggggaccacgtaccatcagaccacggtacccaatcaacgccaactcgacctaacagtcggacctgacggcgggccttgggaccagtcgcgaacgttcgacggtcataattcgngngngnggaag

SEQ ID NO: 401978 - DNA, 576 bp, Homo sapiens
  misc_feature: GZ8MTXP01ETBSJ.4.37.D04.1.454.CMB.2.raw
  modified_base (254)..(254): a, c, t, g, unknown or other
  modified_base (566)..(566): a, c, t, g, unknown or other
  modified_base (570)..(570): a, c, t, g, unknown or other
  modified_base (572)..(572): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtgggctggaggtagaagagccgtgggcctgagtgaagtctctgcaaggtcttcgnggactaccaccttcaccgtctatatatcgactacgtgggtcgccgacgtcggcccctagggacgaagggtctttaggagtggagtgggatggactaccgactaagcggcggtacgacaacgaaagtagcgacgaacgaaggtaacgtttacgacgggacgtacggggtaccaacgagtacggaaccgaacgggaccacgtaccacacgaacgaccgaccggtacagtaccgacgacacgacgacctaacacgtcgacgtcggacggcggtcgttacgacgacgtcgtacgacgcgacggtctataacgttgngagngnggtg

SEQ ID NO: 401979 - DNA, 558 bp, Homo sapiens
  misc_feature: GZ8MTXP01DDV6I.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcaccgcctactatatgcacgtgggtgcgactcggcccctggaccgaagggtctttggaggtggagtggggatggactccggacctaagagcggtaggacaacgaaagtatgacaacgaggtaaagtttcgagggcgagggtacaccgatacgaccgagggacacgtacactcagccacggtccatcacgcaacacgacctaacacgtcggaccctggaacggccgggcgttacggaccgaagtccgacgaacgacgacggtcgtagttaactttcgtgttgtcggaaggaagg

SEQ ID NO: 401980 - DNA, 532 bp, Homo sapiens
  misc_feature: GZ8MTXP01CO17K.4.37.D04.1.454.CMB.2.raw
  modified_base (498)..(498): a, c, t, g, unknown or other
  modified_base (524)..(524): a, c, t, g, unknown or other
  modified_base (526)..(526): a, c, t, g, unknown or other
  modified_base (528)..(528): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactcggccccctggacaagggcttgagtggagtgggatggactcggacctaagaggcggtaggctaacgaaagtataggacacgaggtaaagtttcgaggggtcaggggtcaccgaagtacgaccgaggggacacgtaccatcaagccacgggtcccaatccagaccaacacgcctacatcggacctgacgcgggcttggacaagtcgngacgttacgacgcgtataattctggngngnggtg

SEQ ID NO: 401981 - DNA, 495 bp, Homo sapiens
  misc_feature: GZ8MTXP01DA2YE.4.37.D04.1.454.CMB.2.raw
  modified_base (339)..(339): a, c, t, g, unknown or other
  modified_base (428)..(428): a, c, t, g, unknown or other
  modified_base (444)..(444): a, c, t, g, unknown or other
  modified_base (467)..(467): a, c, t, g, unknown or other
  modified_base (482)..(482): a, c, t, g, unknown or other
  modified_base (490)..(490): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggactcggacctaanagcggtaggcaacgaaagtatggcacaggaagtttcgaggtcagggtcacatgacagggacacgtccatcagcacggtcatcagcaacngcctacatggacctgngcggcttggacagtcgcgagacncggctataacgtttntgttgtgnggaag

SEQ ID NO: 401982 - DNA, 534 bp, Homo sapiens
  misc_feature: GZ8MTXP01CY1PM.4.37.D04.1.454.CMB.2.raw
  modified_base (255)..(255): a, c, t, g, unknown or other
  modified_base (377)..(377): a, c, t, g, unknown or other
  modified_base (450)..(450): a, c, t, g, unknown or other
  modified_base (471)..(471): a, c, t, g, unknown or other
  modified_base (492)..(492): a, c, t, g, unknown or other
  modified_base (522)..(522): a, c, t, g, unknown or other
  modified_base (529)..(529): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttcgnggatacaccttcaccgcctaactatatgcacgtgggtgccgacgtcggccccctaggacgaagggtctttggaggtggatggggatggacctcggacctaagaggcggtagacaagaaagtntgacaacgagtaagttcgagggcagggtcacgagtcgaaccgagggacacgtaccagtcagccacggtccaancacgacacgacgacctaacgngtcggacctggacggcggcgngacacgtcgacgacgcgacgctatcgttgngcgtggnggaag

SEQ ID NO: 401983 - DNA, 523 bp, Homo sapiens
  misc_feature: GZ8MTXP01DT0LR.4.37.D04.1.454.CMB.2.raw
  modified_base (249)..(249): a, c, t, g, unknown or other
  modified_base (347)..(347): a, c, t, g, unknown or other
  modified_base (366)..(366): a, c, t, g, unknown or other
  modified_base (506)..(506): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctctgcaaggctcngatacaccttcaccgctactatatgctacgtggggtgcgacgtcggcccctggacgaagggctttggagtggagtgggatggactccggaacctaagngcggtaggacaacaaagtntagcacgagtagtttcgagggcagggtcacgatcgaccgagggacacgtcatcagcacggtcatcacgcacacgtcctaacagtcggacctggacgcggcttgacttagtcgagaccgcgaccggtccgtaatctttcgngttaggtcggaagggtg

SEQ ID NO: 401984 - DNA, 543 bp, Homo sapiens
  misc_feature: GZ8MTXP01A5Z3U.4.37.D04.1.454.CMB.2.raw
  modified_base (224)..(224): a, c, t, g, unknown or other
  modified_base (341)..(341): a, c, t, g, unknown or other
  modified_base (361)..(361): a, c, t, g, unknown or other
  modified_base (481)..(481): a, c, t, g, unknown or other
  modified_base (488)..(488): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggcctnagtgagtctctgcaggcttctggatacaccttcaccgcctactatatcgcacgtgggtgcgactcggcccctggacgaagggctttggagtggagtgggatggactccgacctaagnggcggtagacaacgaaagtngacacgagtaagttcgagggcgagggtcaccgagtacgaccgagggacacgtaccagtacagccacgggtaccagtacacgccacgacgacctacgagtcggacctggacgccgggtccnggaccgngacgtcgacgcgaccggtccggttatcgtttcggnggttacggcggaagggtaag

SEQ ID NO: 401985 - DNA, 516 bp, Homo sapiens
  misc_feature: GZ8MTXP01DXFEQ.4.37.D04.1.454.CMB.2.raw
  modified_base (224)..(224): a, c, t, g, unknown or other
  modified_base (244)..(244): a, c, t, g, unknown or other
  modified_base (341)..(341): a, c, t, g, unknown or other
  modified_base (417)..(417): a, c, t, g, unknown or other
  modified_base (446)..(446): a, c, t, g, unknown or other
  modified_base (478)..(478): a, c, t, g, unknown or other
  modified_base (502)..(502): a, c, t, g, unknown or other
  modified_base (510)..(510): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggctnagtgagtctctgcaggctcngatacactcaccgctactatatgcactgggtgcgactcggccccctagggaccaaggggctttggagtggatggggatgggactccggaacctaagnggtcggtaggacaagaaagtatgcaacagaaagtttcgaggggtcagggtcaccgatagaaccagggacacgtcancagcacggtccatcagcacacgcctaacncgtcggacctggagcggccttggacacgtcgngacgcgacggtcgtaattcttcgngttggtgngggaag

SEQ ID NO: 401986 - DNA, 516 bp, Homo sapiens
  misc_feature: GZ8MTXP01BZ1PC.4.37.D04.1.454.CMB.2.raw
  modified_base (226)..(226): a, c, t, g, unknown or other
  modified_base (245)..(245): a, c, t, g, unknown or other
  modified_base (363)..(363): a, c, t, g, unknown or other
  modified_base (453)..(453): a, c, t, g, unknown or other
  modified_base (478)..(478): a, c, t, g, unknown or other
  modified_base (483)..(483): a, c, t, g, unknown or other
  modified_base (504)..(504): a, c, t, g, unknown or other
  modified_base (506)..(506): a, c, t, g, unknown or other
  modified_base (509)..(509): a, c, t, g, unknown or other
  modified_base (512)..(512): a, c, t, g, unknown or other
  modified_base (515)..(515): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtgggctnagtgagtctctgcagctcngatacacctcaccgctactatatgcacgtgggtgccgacgtcggcccctaggacgtagggctttggaggtggagtggggatggactccggacctaagaggcggtagacaacgaaagtntggacacgagtaagttcgagggacagggtacacagtcgaaccgagggacacgtcatcgagcacggtcatcgagccaacgtacgcctacgngtcggacctggacgcggcttggacngtcgngacgttcacggtctatcttgngnggnggnggng

SEQ ID NO: 401987 - DNA, 475 bp, Homo sapiens
  misc_feature: GZ8MTXP01B7ZMJ.4.37.D04.1.454.CMB.2.raw
  modified_base (222)..(222): a, c, t, g, unknown or other
  modified_base (418)..(418): a, c, t, g, unknown or other
  modified_base (460)..(460): a, c, t, g, unknown or other
  modified_base (464)..(467): a, c, t, g, unknown or other
  modified_base (469)..(470): a, c, t, g, unknown or other
  modified_base (472)..(472): a, c, t, g, unknown or other
  modified_base (474)..(474): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttctggatacacctcaccgcctactatatgcactgggtgcgactggccccctggacaagggcttgagtggatgggatggatccgaccctaacagcggtggcacaagtatgcacagaagtttcagggcagggtcaccatgaccagggacacgtccatcagcacgtccatcagcacngcctacatggacctgagcgggctgggcaaggcgcgattacgngctnnnngnngngng

SEQ ID NO: 401988 - DNA, 576 bp, Homo sapiens
  misc_feature: GZ8MTXP01E0CTV.4.37.D04.1.454.CMB.2.raw
  modified_base (226)..(226): a, c, t, g, unknown or other
  modified_base (246)..(246): a, c, t, g, unknown or other
  modified_base (341)..(341): a, c, t, g, unknown or other
  modified_base (359)..(359): a, c, t, g, unknown or other
  modified_base (555)..(555): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggctnagtgaggtctctgcaggctnggatacaccttcaccgcctactatatgcacgtgggtgcgacgtcggcccctaggacgaagggcttggagtggagtgggatggactcgacctaagngcggtagacaacaaagtnagacaacgagtacgtttcgaggggacgagggtacacgagtacgaacccgaggggaaccaccggtaccagtaccgaacgccgaaccgggtccaatccgacgaccaacgacgaccctacgacgtcgggaccctggacggccgggcgttacggaccgttaacgtccgacgaaccgacggaccgggtcctattcgttggnggttacggtcggaagggtaag

SEQ ID NO: 401989 - DNA, 526 bp, Homo sapiens
  misc_feature: GZ8MTXP01AR2JP.4.37.D04.1.454.CMB.2.raw
  modified_base (349)..(349): a, c, t, g, unknown or other
  modified_base (516)..(516): a, c, t, g, unknown or other
  modified_base (518)..(518): a, c, t, g, unknown or other
  modified_base (520)..(520): a, c, t, g, unknown or other
  modified_base (522)..(522): a, c, t, g, unknown or other
  modified_base (525)..(525): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcaccgtcctactatatgcacgtgggtgcgactcggcccctggacaagggcttggaggtggatggggatggactccgacctaagnggcggtaggacaacgaaagtatagacacgagtaacgtttcgagggacaggggtcaaccgatacgaaccgagggaccacgtccagtcagcacggtcagtccagaccacgacgcctagacgtggacctggacgcggcttaggacagcgagacgcgacgcgtatcgttgngngngnggng

SEQ ID NO: 401990 - DNA, 505 bp, Homo sapiens
  misc_feature: GZ8MTXP01ERQSG.4.37.D04.1.454.CMB.2.raw
  modified_base (248)..(248): a, c, t, g, unknown or other
  modified_base (283)..(283): a, c, t, g, unknown or other
  modified_base (426)..(426): a, c, t, g, unknown or other
  modified_base (487)..(487): a, c, t, g, unknown or other
  modified_base (495)..(495): a, c, t, g, unknown or other
  modified_base (497)..(497): a, c, t, g, unknown or other
  modified_base (499)..(499): a, c, t, g, unknown or other
  modified_base (502)..(502): a, c, t, g, unknown or other
  modified_base (504)..(504): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctggggcctcagtgaaggtctcctgcaaggcttcnggatacacctcaccgcctactatatgcactgggtncgactggcccctggacaagggcttgagtggagtgggatggatccgaccctaagagcggtggacaacaagtatggcacgagaagtttcgagggcacgggtcacgatcgacgagggacacgtcatcagcacgtcgatcagcaacncgcctacactcggacctggacgccgggctacgggacaacggttcgacgacgacgcgccgtntatctggngngnggngng

SEQ ID NO: 401991 - DNA, 514 bp, Homo sapiens
  misc_feature: GZ8MTXP01AWH5E.4.37.D04.1.454.CMB.2.raw
  modified_base (251)..(251): a, c, t, g, unknown or other
  modified_base (360)..(360): a, c, t, g, unknown or other
  modified_base (444)..(444): a, c, t, g, unknown or other
  modified_base (471)..(471): a, c, t, g, unknown or other
  modified_base (498)..(498): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaaggtctcctgcaggcttcnggatacaccttcaccgcctactatatgcacgtgggtgcgactcggcccctggacaagggcttggagtgatgggatggactcgacctaagagcggtaggcaacgaaagtntgacacgagtaagtttcgagggcagggtcaccgatagaccgagggacacgtccatcagcacggtcatcacgcacacgcctaacntcggacctgcgcggccttgacagtcgngacgacgaccggtcctataactttcgngttcgcggaagggaag

SEQ ID NO: 401992 - DNA, 547 bp, Homo sapiens
  misc_feature: GZ8MTXP01D7PEY.4.37.D04.1.454.CMB.2.raw
  modified_base (351)..(351): a, c, t, g, unknown or other
  modified_base (372)..(372): a, c, t, g, unknown or other
  modified_base (465)..(465): a, c, t, g, unknown or other
  modified_base (529)..(529): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccaggtgcagctggtgcagtctggggctgaggtgaagagccgtggggcctcagtgaaggtctcctgcaaggcttctggatacaccttcacccgtcctaactatatgcacgtgggtgcgactcggcccctggacgaagggctttggaggtggagtgggatggactccgacctaagnggcggtaggacaacgaaagtntacgacaacgagtaaaggtttcgagggcgagggtcacgagtagaccgagggacacgtccatcacgccacggtccatcacgcacacgcctaacngtacggacctggacgcggccttggacttagtcgtacgacgcgaccggtcctagttaactttcgnggttcggtcggaagggtg

SEQ ID NO: 401993 - DNA, 512 bp, Homo sapiens
  misc_feature: GZ8MTXP01AVNYJ.4.37.D04.1.454.CMB.2.raw
  modified_base (225)..(225): a, c, t, g, unknown or other
  modified_base (340)..(340): a, c, t, g, unknown or other
  modified_base (492)..(492): a, c, t, g, unknown or other
  modified_base (503)..(503): a, c, t, g, unknown or other
  modified_base (507)..(507): a, c, t, g, unknown or other
  modified_base (509)..(509): a, c, t, g, unknown or other
  modified_base (511)..(511): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttcgtggatacaccttcaccgcctactatatgcacgtgggtgcgactggcccctggacaagggcttgagtggatgggatggactcgacctaagngcggtgacaacaaagtatgacacagaacgtttcgagggtcgagggtacacagtgaaccgaggggacacggtccatcagccacggtccatcacgcacacgcctagctcgggactagacgggcggtcgttaggacgacggtcgacgacgttacncggcatcttgngcgngngng

SEQ ID NO: 401994 - DNA, 515 bp, Homo sapiens
  misc_feature: GZ8MTXP01CZX5W.4.37.D04.1.454.CMB.2.raw
  modified_base (226)..(226): a, c, t, g, unknown or other
  modified_base (251)..(251): a, c, t, g, unknown or other
  modified_base (502)..(502): a, c, t, g, unknown or other
  modified_base (510)..(510): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggctnagtgaaggtctcctgcaaggcttcnggatacaccttcaccgcctactatatgcacgtgggtgcgacgtcggcccctgggacaagggctttggagtggagtggatggactcggacctagagcggtagcaacgaaagtatagcacagaagtttcagggcagggtcacatcgacagggacacgtcatcagcacggtccatcacgcacgacgcctaacgatcgggacctggacgcgggccgttaggaccagtacgcgaacgacacgccgtaattcgtcgngttcgcgnggaag

SEQ ID NO: 401995 - DNA, 514 bp, Homo sapiens
  misc_feature: GZ8MTXP01DH6MA.4.37.D04.1.454.CMB.2.raw
  modified_base (228)..(228): a, c, t, g, unknown or other
  modified_base (250)..(250): a, c, t, g, unknown or other
  modified_base (345)..(345): a, c, t, g, unknown or other
  modified_base (364)..(364): a, c, t, g, unknown or other
  modified_base (437)..(437): a, c, t, g, unknown or other
  modified_base (446)..(446): a, c, t, g, unknown or other
  modified_base (465)..(465): a, c, t, g, unknown or other
  modified_base (494)..(494): a, c, t, g, unknown or other
  modified_base (498)..(498): a, c, t, g, unknown or other
  modified_base (502)..(502): a, c, t, g, unknown or other
  modified_base (505)..(505): a, c, t, g, unknown or other
  modified_base (507)..(507): a, c, t, g, unknown or other
  modified_base (509)..(509): a, c, t, g, unknown or other
  modified_base (511)..(511): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctnagtgaaggtctctgcaaggctntggatacaccttcaccgctactatatgcacgtgggtcgcgactcggcccctggacgaagggtcttgagtggagtgggatggactccgacctaagngcggtagacaacaaaggtnaggacacgagtaagttcgagggtcagggtcaacgatacgaaccgagggacacgtacatcagcacggtcctaancacgcaacncgacctacgatcggacccnggacgcgggccttggacttagcgagacgncggntatntgngngngngng

SEQ ID NO: 401996 - DNA, 525 bp, Homo sapiens
  misc_feature: GZ8MTXP01DCF9Q.4.37.D04.1.454.CMB.2.raw
  modified_base (353)..(353): a, c, t, g, unknown or other
  modified_base (513)..(513): a, c, t, g, unknown or other
  modified_base (518)..(518): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgctactatatgcacgtgggtgcgacgtcggaccacgtgggacaaggggtcttggagtggagtggggatcggatacgaccctaacgnggcgggtgcaacgaaagtatgacacaggtaagtttcgagggcgagggtacaccgagtacgaccgagggacacgtcatcacgcacgtcatcagcacgacgacctacacgtggacctggaacgcggctgacgatcgacgacgacgcggacttaatagttcgnggtgnggaaggg

SEQ ID NO: 401997 - DNA, 598 bp, Homo sapiens
  misc_feature: GZ8MTXP01AZ8BK.4.37.D04.1.454.CMB.2.raw
  modified_base (345)..(345): a, c, t, g, unknown or other
  modified_base (367)..(367): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtgggggcctcagtgaaggtctcctgcaaggcttctggatacaccttcaccgctactatatgcactgggtgcgacgtcggcccctggacaggggcttggagtggatggggatggactccgacctagnggcggtagacaacgaaagtagngacagtagtaagttcggagggcgtacgggtcacgagtacgaaccggaggaccacgtaccgactacgaacgaccgtaccggtaccacgtaccgacgaccaaccgacgtaccctaacgtacggtaccggtaccgtagggaccgggtcccgggccgttacggaacgacggtaccgtaacggaaccgttacggaccggtcgtacttaacgtcgtggcgtaacgggaaggtaaggg

SEQ ID NO: 401998 - DNA, 495 bp, Homo sapiens
  misc_feature: GZ8MTXP01B5O9E.4.37.D04.1.454.CMB.2.raw
  modified_base (353)..(353): a, c, t, g, unknown or other
  modified_base (437)..(437): a, c, t, g, unknown or other
  modified_base (477)..(477): a, c, t, g, unknown or other
  modified_base (485)..(485): a, c, t, g, unknown or other
  modified_base (487)..(487): a, c, t, g, unknown or other
  modified_base (491)..(491): a, c, t, g, unknown or other
  modified_base (494)..(494): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaaggtctcctgcaaggcttctggatacaccttcaccgcctactatatgcacgtgggtgcgactcggcccctggacgagggctttggagtggatgggatggactcgacctagagcggtgcaanaaagtatgcagagtaagtttcgagggcagggtcacgtatgaccgagggaccacgtcatcagcacggtcatcagcacagcctacngtggacctggagcggcttggacagtcgtgacgcgacgctntaattcgngngcgnggng

SEQ ID NO: 401999 - DNA, 604 bp, Homo sapiens
  misc_feature: GZ8MTXP01CJBDC.4.37.D04.1.454.CMB.2.raw
  modified_base (251)..(251): a, c, t, g, unknown or other
  modified_base (587)..(587): a, c, t, g, unknown or other
  modified_base (598)..(598): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctctgcaggcttntggatacaccttcaccgcctactatatcgcacgtgggtcgcgacgtcggccccgtggacgaaggggctttggaggtggagtgggatggactccgacctaacgaggcggtaggacaacgaaagttacgaggacaacgaggtaacgtttcgaggggcgtacgggtaccaaccgagtacggaaccgacggggaccaccggtaccactcgaacgcccgaccggggtccaacgtccgaacgaccaaccgacggaccctaacgacgtcgggacctggacgggccgggcgttgggaaccgacgtccgtcggaccgttcgaccgggtcctagttaactttcggngttacggcggnggaagg

SEQ ID NO: 402000 - DNA, 494 bp, Homo sapiens
  misc_feature: GZ8MTXP01A5YHT.4.37.D04.1.454.CMB.2.raw
  modified_base (288)..(288): a, c, t, g, unknown or other
  modified_base (425)..(425): a, c, t, g, unknown or other
  modified_base (458)..(458): a, c, t, g, unknown or other
  modified_base (487)..(487): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccgcctactatatgcactggggtncgactggcccctggacaagggcttgagtggatgggatggatcgactaacagcggtaggcaacaaagtatgcacaagagtttcagggcaggggtcacatgaccaggggacacgtccatcagcacggtccatcagcacngcctacatggacctgagcggcttggaccagtcncgacgacacggctataacttctgttgcgngggaagg

SEQ ID NO: 402001 - DNA, 537 bp, Homo sapiens
  misc_feature: GZ8MTXP01EJ3NJ.4.37.D04.1.454.CMB.2.raw
  modified_base (227)..(227): a, c, t, g, unknown or other
  modified_base (252)..(252): a, c, t, g, unknown or other
  modified_base (374)..(374): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctcctgcaaggcttcnggatacaccttcaccgctactatatgcacgtgggtcgcgactcggcccctgggacaagggtcttggaggtggagtggggatgggactccggaacctaagaggcggtaggacaacgaaaagtntcgacagtaggaagtttcgagggcgagggtcacagtcgaaccgagggacacgtcagtcagcacggtcatcgacgacacagcctacgagtcgaccctggacggcggcgttggacacgtcgacgacgacaccgggtctataacgtttcggngttcgcggaaggtg

SEQ ID NO: 402002 - DNA, 514 bp, Homo sapiens
  misc_feature: GZ8MTXP01BNLNK.4.37.D04.1.454.CMB.2.raw
  modified_base (342)..(342): a, c, t, g, unknown or other
  modified_base (360)..(360): a, c, t, g, unknown or other
  modified_base (503)..(503): a, c, t, g, unknown or other
  modified_base (510)..(510): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacaagggcttgagtggatggatggactcggacctaagngcggtagcaacgaaagtntgacacagtaacgtttcgagggcagggtcacgagtacgaccgagggacacgtcatcagcacggtcatcacgcacgacgcctacattcgacctgacggcggtccgttggaccaagtcgcgaacgttcgacggctataacttcgngcgtggnggng

SEQ ID NO: 402003 - DNA, 532 bp, Homo sapiens
  misc_feature: GZ8MTXP01C28OI.4.37.D04.1.454.CMB.2.raw
  modified_base (226)..(226): a, c, t, g, unknown or other
  modified_base (248)..(248): a, c, t, g, unknown or other
  modified_base (362)..(362): a, c, t, g, unknown or other
  modified_base (460)..(460): a, c, t, g, unknown or other
  modified_base (517)..(517): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctnagtgaggtctctgcaggcttcngatacacctcaccgtcctactatatgcacgtgggtcgcgactcggcccctggacagggtcttggagtggagtgggatggactccgaacctagaggcggtaggacaacgaaagtntacggacacgaggtaagtttcgagggtacgacgggtacacgatacggaaccgacgggacacgtacatcagccacggtcatcagcacgacgcctaacgngtcggactggacggcggcttagacagtcgtcgacgttcgacggtctagttcgttcgngttggnggaagggtg

SEQ ID NO: 402004 - DNA, 530 bp, Homo sapiens
  misc_feature: GZ8MTXP01DDEJC.4.37.D04.1.454.CMB.2.raw
  modified_base (363)..(363): a, c, t, g, unknown or other
  modified_base (524)..(524): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccaggtgcagctggtgcagtcgtggggctgaggtgaagagccgtggggcctcagtgaaggtctcctgcaaggcttctggatacaccttcaccgcctactatatgcacgtgggtcgcgactcggcccctggacaaggggtctttggagtggatggatggactcgacctagagcggtgacaagaaagtntgacaacgagtaaagtttcgagggcagggtcacgatagaaccgagggacaccgtacatacgacgcgacggtaccataccgacgccaacgacgacctaacacgtcggaccgtgacggcggcttgacagtcgtgacgcgacgcgtatcgttcgtagttgcggngggaag

SEQ ID NO: 402005 - DNA, 574 bp, Homo sapiens
  misc_feature: GZ8MTXP01ELCHO.4.37.D04.1.454.CMB.2.raw
  modified_base (253)..(253): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcagtgaggtctcctgcaaggcttcnggatacaccttcaccgcctactatatgcacgtgggtgcgacgtcggcccctggacgaagggcttggagtggagtgggatggactccgaacctaagagcggtaggacaacgaaaagtatagacaacgaggtaaagtttcgagggtcgagggtcacagtacgaacgagggacacgtcatcagcacggtcatcagcaacacgacctaacacgtacggacctggacggccgggtccttaggacttacgtccgtacggaaccggaccgaccgggtaacccggttaagttaactttccgtagggttcggtaacgggaaggggtaagg

SEQ ID NO: 402006 - DNA, 570 bp, Homo sapiens
  misc_feature: GZ8MTXP01C7PMZ.4.37.D04.1.454.CMB.2.raw
  modified_base (351)..(351): a, c, t, g, unknown or other
  modified_base (564)..(564): a, c, t, g, unknown or other
  modified_base (566)..(566): a, c, t, g, unknown or other
  modified_base (569)..(569): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctgggggcctcagtgaaggtctcctgcaaggcttctggatacaccttcaccgcctactatatgcacgtgggtgcgactcggcccctggacgaagggtctttggagtggatggggatggactaccgacctaacgnggcggtggacaacgaaagtatgacaacgagtaagtttacgaggggacgagggtcaaccgagtacggaaccgaggggtacaccggtaccagtcacgtaccgacgggttacccataccgaacgaccaaccgacggcccttaacacgtcgggaaccctggaacggccgggccgttaggaccgaagtccgacgacgacgcgcgtatcgtgtgttggngnggng

SEQ ID NO: 402007 - DNA, 588 bp, Homo sapiens
  misc_feature: GZ8MTXP01EOGWL.4.37.D04.1.454.CMB.2.raw
  modified_base (254)..(254): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtagaagaagccgtgggggcctcagtgaaggtctcctgcaaggcttcnggatacaccttcaccgcctaactatatgcacgtgggtgccgacgtcgggcccccttgggaccgaaggggcctttaggaggtggatgggggactggactccggacctaagaggcggtaggaccaacgaaaggtatgacaacgaaggtaacgttttcgacggggtcgaggggtcaaccgagtagaaccgaggggacacggtaccatcaagccacggtcatacacgaccaacgacgcctaaacntacggacccgtggacggcggtccgttacggaccaagtccgtacgaaccgaccgacggccgttagtaacttgtggttcggtcggaagggtaagg

SEQ ID NO: 402008 - DNA, 499 bp, Homo sapiens
  misc_feature: GZ8MTXP01BD061.4.37.D04.1.454.CMB.2.raw
  modified_base (355)..(355): a, c, t, g, unknown or other
  modified_base (431)..(431): a, c, t, g, unknown or other
  modified_base (458)..(458): a, c, t, g, unknown or other
  modified_base (482)..(482): a, c, t, g, unknown or other
  modified_base (493)..(493): a, c, t, g, unknown or other
tcagagcactgtagcacgaccggtgctcgatttagtagcatactgttgggtttggggagcatcacccaacaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacacctcaccgcctactatatgcacgtgggtgcgactggcccctggacagggcttgagtggagtgggatggatccgacctacagcggtgaacacaagtntgcacagtaagttcgagggcagggtcacagtcgacgagggacacgtccatcagcacgtcgatcagcacacgcctanactcggacctggacgcggctgacgacncgtgaacgcgcgcgtaatagttcngtgcgtaaggngaaggg

SEQ ID NO: 402009 - DNA, 570 bp, Homo sapiens
  misc_feature: GZ8MTXP01CYI3V.4.37.D04.1.454.CMB.2.raw
  modified_base (560)..(560): a, c, t, g, unknown or other
  modified_base (566)..(566): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcaccgcctactatatgcacgtgggtgccgacgtcggccccctaggaacaaaggctttggaggtggagtggggatgggactcggaacctaagaggcgggtaggacaacgaaaaggtataggacaacgaagaaacgtttcgaaggggtaagggtcaacctagtacgaaccgaagggaccacgtaccatacacgacgaccgttacactcgaacgccaacacgacccacgaagtcggaacctggacggcgggcctaggcctaagcgtacgaacgttacgacggcgtaatagttctgtgngaaggngaag

SEQ ID NO: 402010 - DNA, 557 bp, Homo sapiens
  misc_feature: GZ8MTXP01A0KW4.4.37.D04.1.454.CMB.2.raw
  modified_base (548)..(557): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaggcttctggatacaccttcaccgcctactatatgcacgtgggtgcgactcggcccctggacagggcttggagtggagtggggatggactccggacctaagaggcggtaggacaacgaaagtatgacaacgagtaagtttcgaggggcgaagggtcaacgagtacggaacccgagggaaccaccggtaccagtccgaacgccgaccggggttaccaacgtccaacgccaaccgacgaccctaacgacgtcgggacccgtgggacggccggggtcgttacgggacgaacgggcgacgagttagnnnnnnnnnn

SEQ ID NO: 402011 - DNA, 648 bp, Homo sapiens
  misc_feature: GZ8MTXP01AGUEA.4.37.D04.1.454.CMB.2.raw
  modified_base (250)..(250): a, c, t, g, unknown or other
  modified_base (629)..(629): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtgggctggaggtgaagagccgtgggcctgagtgagtctctgcaggtcttcgnggactacaccttcaccgtcctactatatcgctacgtgggtcgcgacgtcggccccgtggacgagggtcttggaggtggagtgggagtacggacctaccggaacctaaggcggtcgggtaacggaaccaacgtaaagtatacggacgaacgtaaggttaaacggtttacggacggggtacgtaacggggtaccaaccggtaagtacggaaacccggaacggggacctaccggtaccacgtaccgaacgtacccgaaccgggtaccaacgtccgaacggaccaaccgaccggacctaacgacgtaccggaccgtacgggacggccggtaccgttacggaccgacggtcgtacgaccggttcgaccggtctattcgtttggnggttacggaacggaaggtg

SEQ ID NO: 402012 - DNA, 641 bp, Homo sapiens
  misc_feature: GZ8MTXP01C94IV.4.37.D04.1.454.CMB.2.raw
  modified_base (258)..(258): a, c, t, g, unknown or other
  modified_base (630)..(630): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccgaggtgcagcgtggtgcagtcgtgggctggaggtagaagacgccgtggggcctgagtgaaggtctctgcaggtcttcgnggactaccaccttcacccgtctactatatgcacgtgggtcgcgacgtccggccccgtagggacgtagggtcttggaggtggagtgggatcggacctccgaaccgtagcggcggtaagacaacgtaaagtatacggacgaacgtaaggtacggttacggagggtacgtacggtaccaacgtagacggaaccggaacgggacctaaccggtacacgtaccgaagacccgtaaccggtaccctaactccgaaccggaccaaccgtacggtaccctaacgacgtaccgggacccgtagggaaccggtccggtaccttagggaaccttcgtaccgggacgaaccgcgttaccggtctaatttcgtcggtggaccggngggaaggtggg

SEQ ID NO: 402013 - DNA, 490 bp, Homo sapiens
  misc_feature: GZ8MTXP01AEAP9.4.37.D04.1.454.CMB.2.raw
  modified_base (340)..(340): a, c, t, g, unknown or other
  modified_base (357)..(357): a, c, t, g, unknown or other
  modified_base (460)..(460): a, c, t, g, unknown or other
  modified_base (466)..(466): a, c, t, g, unknown or other
  modified_base (480)..(480): a, c, t, g, unknown or other
  modified_base (487)..(487): a, c, t, g, unknown or other
  modified_base (489)..(489): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaaggggcttggagtggatgggatggactcgacctaanagcggtgcaacaaagtntgcacagaagtttcagggcagggtcacgatgacagggacacgtccatcagcacggtcatcagcacagcctacatggacctgacggcgggccttggacagtcgngacgcncggctataacttcngttgcgngng

SEQ ID NO: 402014 - DNA, 486 bp, Homo sapiens
  misc_feature: GZ8MTXP01A06UP.4.37.D04.1.454.CMB.2.raw
  modified_base (251)..(251): a, c, t, g, unknown or other
  modified_base (334)..(334): a, c, t, g, unknown or other
  modified_base (349)..(349): a, c, t, g, unknown or other
  modified_base (454)..(454): a, c, t, g, unknown or other
  modified_base (474)..(474): a, c, t, g, unknown or other
  modified_base (481)..(481): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcactgggtgcgactggcccctggacagggcttgagtgatggatggactcgactagngcgtgcaacaaagtntgcacgagagtttcgagggcgagggtcaccgatgaccgagggacacgtcatcagcacggtcatcagcacacgcctacagtcggactgagcggcttggacagtcgngacgcgacgcgtatcttcgngttgcgnggaag

SEQ ID NO: 402015 - DNA, 521 bp, Homo sapiens
  misc_feature: GZ8MTXP01AV4E5.4.37.D04.1.454.CMB.2.raw
  modified_base (252)..(252): a, c, t, g, unknown or other
  modified_base (354)..(354): a, c, t, g, unknown or other
  modified_base (360)..(360): a, c, t, g, unknown or other
  modified_base (438)..(438): a, c, t, g, unknown or other
  modified_base (458)..(458): a, c, t, g, unknown or other
  modified_base (484)..(484): a, c, t, g, unknown or other
  modified_base (512)..(512): a, c, t, g, unknown or other
  modified_base (517)..(517): a, c, t, g, unknown or other
  modified_base (520)..(520): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccgcctactatatgcacgtgggtgcgactcggcccctaggacaagggctttggagtggatgggatggactcgactagagcggtagcaanaaagtngcacagtaagtttcgagggcgagggtcacgagtacgacgagggacacggtacatacagccacggtccatccacgcacncgacctacacgtcggacccnggacgccgggcttgggacagtaccgngacgcgacggaaccgtataacttggtgngtggnggng

SEQ ID NO: 402016 - DNA, 533 bp, Homo sapiens
  misc_feature: GZ8MTXP01EQPHB.4.37.D04.1.454.CMB.2.raw
  modified_base (227)..(227): a, c, t, g, unknown or other
  modified_base (252)..(252): a, c, t, g, unknown or other
  modified_base (353)..(353): a, c, t, g, unknown or other
  modified_base (369)..(369): a, c, t, g, unknown or other
  modified_base (494)..(494): a, c, t, g, unknown or other
  modified_base (520)..(520): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctcctgcaaggcttcnggatacaccttcacccgtcctactatatgctacgtgggtcgcgacgtcggccccctgggaacaaggggtcttggaggtggatgggatggactcgacctagngcggtgcaagaaagtntgacaacgagtaacgtttcgagggcaggggtacacgagtcgaaccgagggaccacgtccagtcacgcacggtacacgtcacgcacacgacctacacgtcggactggagcggcttggacttagtcncgacgacgacgtcgtataacttgtgngtcggaagggaag

SEQ ID NO: 402017 - DNA, 494 bp, Homo sapiens
  misc_feature: GZ8MTXP01C5HD6.4.37.D04.1.454.CMB.2.raw
  modified_base (250)..(250): a, c, t, g, unknown or other
  modified_base (336)..(336): a, c, t, g, unknown or other
  modified_base (483)..(483): a, c, t, g, unknown or other
  modified_base (485)..(485): a, c, t, g, unknown or other
  modified_base (487)..(487): a, c, t, g, unknown or other
  modified_base (489)..(489): a, c, t, g, unknown or other
  modified_base (491)..(491): a, c, t, g, unknown or other
  modified_base (493)..(493): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacacctcaccgcctactatatgcactgggtgcgactggcccctggacaagggcttgagtggatgggatggatccgacctaangcggtggacaacaagtatgacacagaagttcagggcagggtcacatgaccgagggacacgtcatcagcacgtcatcagcacacgcctacagtcggaaccctggacgcgggctggacagttcgacgacgaacgcgacgtaatattcgngngngngngng

SEQ ID NO: 402018 - DNA, 604 bp, Homo sapiens
  misc_feature: GZ8MTXP01ECIIW.4.37.D04.1.454.CMB.2.raw
  modified_base (228)..(228): a, c, t, g, unknown or other
  modified_base (247)..(247): a, c, t, g, unknown or other
  modified_base (253)..(253): a, c, t, g, unknown or other
  modified_base (367)..(367): a, c, t, g, unknown or other
  modified_base (592)..(592): a, c, t, g, unknown or other
  modified_base (597)..(597): a, c, t, g, unknown or other
  modified_base (599)..(599): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaagtctctgcagctngatacncctcaccgctactatatgcacgtgggtcgcgacgtcggcccctaggacgaaggggtcttggaggtggagtggggatggactcgacctaagaggcggtaaggacaacgaaaagtntacggacaacgtaaggtaacgtttcgacggggtacgaacggggtaccaaccgaagtacggaacccggaacggggaacctaaccggtacccaagtccgaacggtaccaaccggggttacccaagtccgaacggacccaacgacgtaccctaaacgacgttaccggacccgtagggacggccgggaccttgggacacgtcgacgacgttcgacggctataacgttgngttgngnggaag

SEQ ID NO: 402019 - DNA, 536 bp, Homo sapiens
  misc_feature: GZ8MTXP01C7QLF.4.37.D04.1.454.CMB.2.raw
  modified_base (344)..(344): a, c, t, g, unknown or other
  modified_base (366)..(366): a, c, t, g, unknown or other
  modified_base (517)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcaccgcctactatatgcacgtggtgcgactcggcccctggacaagggcttggagtggatgggatggactccgacctaanacggcggtaggacaacaaagtntgacaacgagtaagttcgagggcagggtacacgatcgaccgagggacacgtccatcagcacggtccatcagcacacgcctaacgacgtcggaccctggacggcggcttagggacagtcgacgacgacgaccggtccgtaattcgtttcggnggttacggcggaagggaag

SEQ ID NO: 402020 - DNA, 643 bp, Homo sapiens
  misc_feature: GZ8MTXP01EQZS2.4.37.D04.1.454.CMB.2.raw
  modified_base (228)..(228): a, c, t, g, unknown or other
  modified_base (253)..(253): a, c, t, g, unknown or other
  modified_base (362)..(362): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtggggcctnagtgaaggtctctgcaaggtcttcnggatacaccttcacccgcctaactatatgcacgtggggtgccgacgtcggccccctagggaaccgaaggggtctttggagtggagtggggatggactccggacctaagnggcggtagacaacgaaagtgtcgacaacgtaaggtaacggtttcgaggggtcgagggtccaacgagtacggaaccggacggggtaaccaccggtacaactcgaacgcccaaccgggtaccaactccgaacgccaaccgacgtaccctaacgacgtacgggaaccctggaacggccggtccgttacggacttaacgtccgtaacggaaaccggttccgttaaccgggtaacccttaaagtttcgtttccgggtgggttacggtaacggggttaagggtaagg

SEQ ID NO: 402021 - DNA, 528 bp, Homo sapiens
  misc_feature: GZ8MTXP01AT3Q5.4.37.D04.1.454.CMB.2.raw
  modified_base (366)..(366): a, c, t, g, unknown or other
  modified_base (495)..(495): a, c, t, g, unknown or other
  modified_base (518)..(518): a, c, t, g, unknown or other
  modified_base (522)..(522): a, c, t, g, unknown or other
  modified_base (524)..(524): a, c, t, g, unknown or other
  modified_base (527)..(527): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttcgtggatacaccttcaccgcctactatatgcacgtgggtgcgacgtcggcccctggacgagggcttggagtggatgggatggactccggacctaagagcggtaggcaacgaaaagtntaggcaacgaaggtaaagtttccgaaggggtcaggggtcaaccgatggaaccgagggacaccgtacatcagcacggtcatcagacacacgcctaacagtcggacctggacggcggcttggacttagcgngacgcgacgtcgtataacttcgngcgngnggng

SEQ ID NO: 402022 - DNA, 498 bp, Homo sapiens
  misc_feature: GZ8MTXP01ADBRY.4.37.D04.1.454.CMB.2.raw
  modified_base (486)..(486): a, c, t, g, unknown or other
  modified_base (488)..(488): a, c, t, g, unknown or other
  modified_base (491)..(491): a, c, t, g, unknown or other
  modified_base (495)..(495): a, c, t, g, unknown or other
  modified_base (497)..(497): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggactcgacctaagagcggtaggcaacaaagtatgcacgagaagtttcgagggcagggtcacatgacgagggacacgtcatcagcacggtcatcagcacacgcctacagtcggacctggacggcgggcttacgggacgaaggccgacgacgacgcggctatntntgngcgngng

SEQ ID NO: 402023 - DNA, 569 bp, Homo sapiens
  misc_feature: GZ8MTXP01BZ43O.4.37.D04.1.454.CMB.2.raw
  modified_base (229)..(229): a, c, t, g, unknown or other
  modified_base (251)..(251): a, c, t, g, unknown or other
  modified_base (441)..(441): a, c, t, g, unknown or other
  modified_base (549)..(549): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagagccgtgggcctnagtgagtctctgcaggtcttcnggatacacctcaccgtctactatatgcacgtgggtgccgtacgtcggccccgtaggaccgaagggtcttaggaggtggagtggggatggacctaccgaacctaagacggcggtaagacaacgaaagtatgacaacgaggtaacgtttcgagggcgagggtacaccgagtacggaaccgagggacacgcancgagcacggtcatcacgacacgacgacctaacgacgtcggacctggacggccgggtccttaggaccagtccgaggaaccgttacgaccgtaacgtattaacgttcggnggttacggtcggaaggtaag

SEQ ID NO: 402024 - DNA, 639 bp, Homo sapiens
  misc_feature: GZ8MTXP01D3GDK.4.37.D04.1.454.CMB.2.raw
  modified_base (249)..(249): a, c, t, g, unknown or other
  modified_base (352)..(352): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggctgagtgagtctctgcaggtctgngatacacctcaccgctactatatgctacgtgggtcgcgacgtcggccccgtaggaacgtaagggtcttggaggtggagtggggatggactccgaaccgtaagnggcggtagacaacgaaagtatagacaacgaggtaagtttcgaggggacgagggtacaacgtagtacggaaccggaagggaccgaccggtaccaactacgaacgaccaccgggtactaactacgacgacaaccgacgtacctaacgtacgtacggtaccgtacgggaacggccgggtcgttacggaaccgttaacggttaccgtaacggaaccgggttaaccgaaccgggttaaccggttattaacgttttccggtacgggttacgggtaacgggttaaggggtaagg

SEQ ID NO: 402025 - DNA, 554 bp, Homo sapiens
  misc_feature: GZ8MTXP01BA8NB.4.37.D04.1.454.CMB.2.raw
  modified_base (290)..(290): a, c, t, g, unknown or other
  modified_base (347)..(347): a, c, t, g, unknown or other
  modified_base (366)..(366): a, c, t, g, unknown or other
  modified_base (546)..(546): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcagtgaaggtctcctgcaaggcttcgtggatacgaccttcaccgcctatatatgcacgtgggtncgacgtggccccctggaccaaggggtcttgagtggatgggatggactcgacctaagngcggtgacaacgtaaagtntgacacgagtaagtttcgaggcgagggtcacgagtacgacgaggacacgtcatcagtcacggtcatcacgcacgacgacctaacacgtcgggacccttagggacggccgggtcttagggacaaggttccgtagacgttaccgcggtaaccgtagtaacgttttcgaggttcgtaaccggngggtaagg

SEQ ID NO: 402026 - DNA, 514 bp, Homo sapiens
  misc_feature: GZ8MTXP01AGVL6.4.37.D04.1.454.CMB.2.raw
  modified_base (443)..(443): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttcgtggatacaccttcaccgcctactatatgcacgtgggtgcgactcggcccctggacaagggtcttggagtggatgggatggactcgacctaagagcggtaggacaacgaaagtatgacacgaggaagtttcgagggcgagggtcacatgaccgaggacacgtcatacagcacggtcatcacgcacagcctacntcggactgcgcggcttgacatctacgacgcgaccggtcgtataacgtttctggttcgtcggaagggtaagg

SEQ ID NO: 402027 - DNA, 590 bp, Homo sapiens
  misc_feature: GZ8MTXP01DZ6YN.4.37.D04.1.454.CMB.2.raw
  modified_base (226)..(226): a, c, t, g, unknown or other
  modified_base (386)..(386): a, c, t, g, unknown or other
  modified_base (507)..(507): a, c, t, g, unknown or other
  modified_base (533)..(533): a, c, t, g, unknown or other
  modified_base (571)..(571): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagcgtggggcctnagtgaggtctcctgcaggcttcgtggatacaccttcaccgcctactatatgctacgtgggtcgcgacgtcgggccccctagggaaccgtaaggggtctttaggaggttggaatgggggatgggactccgacctaagaggcggtacggactaacgaaagtntgacaacgtaggtaaaggtttccgaggggtcacggggtacaaccgtagtacggaaccgtaggggaaccacggtaccaagtccaagccgaacggtaccagtcaacgcaaccgacgccctaanacgtcggaccctggaacgccggtccnggacaagtcgacgacgcgacggtccgtatcgtttcggnggttcgcggttaaggtaag

SEQ ID NO: 402028 - DNA, 632 bp, Homo sapiens
  misc_feature: GZ8MTXP01EALRI.4.37.D04.1.454.CMB.2.raw
  modified_base (296)..(296): a, c, t, g, unknown or other
  modified_base (382)..(382): a, c, t, g, unknown or other
  modified_base (613)..(613): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccaggtgcagctggtgcagtcgtggggctggaggtgaagaagccgtggggcctgagtgaaggtctctgacaggtcttcgtggactacaccttcaccgtcctaactatatgcacgtgggcncgactcggccccgtaggacgaaggtctttggagtggatgggatggacctccggaacctaagaggcggtaacggacaacgtaaagtnacgacacgtaaggtaaggtttccgagggcgtaaggggtaccaacgtagacggaaaccggacgggaactacccggtaccacgtcgaacggccctaaccgggttaccaagtaccaacgaccaaccgacgtaccccaaagttacggtccggaacccgtagggaacgggcccggtacttcgggaaaccttacgggacgtaaccgaacgcggttaacgcccgttaatctttcgggngttacgcgggttaaggaag

SEQ ID NO: 402029 - DNA, 512 bp, Homo sapiens
  misc_feature: GZ8MTXP01EG4LN.4.37.D04.1.454.CMB.2.raw
  modified_base (226)..(226): a, c, t, g, unknown or other
  modified_base (249)..(249): a, c, t, g, unknown or other
  modified_base (342)..(342): a, c, t, g, unknown or other
  modified_base (361)..(361): a, c, t, g, unknown or other
  modified_base (445)..(445): a, c, t, g, unknown or other
  modified_base (498)..(498): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaggtctcctgcaggcttcnggatacaccttcaccgctactatatgcacgtgggtgcgacgtcggcccctggacaagggctttggagtggatgggatggactccgacctaagngcggtagacaacgaaagtngacaacgagtaagtttcgagggcagggtcacatacgaaccgagggacacgtcatcagcacggtcatcacgcacacgacctaacngtcgacctgacgcggcttgacagtcgacgacgcgacggtctataactttcggngttgcggaaggaag

SEQ ID NO: 402030 - DNA, 569 bp, Homo sapiens
  misc_feature: GZ8MTXP01DKQFH.4.37.D04.1.454.CMB.2.raw
  modified_base (257)..(257): a, c, t, g, unknown or other
  modified_base (360)..(360): a, c, t, g, unknown or other
  modified_base (550)..(550): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggggctggagggtgaagaagccgtggggcctcagtgaaggtctcctgcaaggcttcgnggatacaccttcaccgcctactatatgctacgtgggtcgccgacgtcggcccctggacgaaggggtcttggaggtggagtggggatggactccgaacctaagngcggtaggacaacgaaagtatgacaacgaggtaagtttcgagggacgagggtacacgatcggaaccgacgggacacgtaccatacgagccacggtcagtcaacgccaacgacgaccctaacgacgtcggaccctggacggccggccttaggaccaagtccgagacgttcgaccggtcgtaatcgtttcgnggttaggcggaagggtaag

SEQ ID NO: 402031 - DNA, 506 bp, Homo sapiens
  misc_feature: GZ8MTXP01BMV1J.4.37.D04.1.454.CMB.2.raw
  modified_base (360)..(360): a, c, t, g, unknown or other
  modified_base (468)..(468): a, c, t, g, unknown or other
  modified_base (472)..(472): a, c, t, g, unknown or other
  modified_base (488)..(488): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccgcctactatatgcactggggtgcgactggcccctggacagggcttgagtggatgggatggactcggacctaagagcggtaggcaacgaaagtntgcaacgaggaaagtttcgagggtcaggggtcaccgatgaaccgagggacacgtccatcagcacggtcatcagcacacgcctacatggaccctgacgcggcttggacngtcngacgcacggccgtatnttctgttgcgngggtaag

SEQ ID NO: 402032 - DNA, 577 bp, Homo sapiens
  misc_feature: GZ8MTXP01BI6C3.4.37.D04.1.454.CMB.2.raw
  modified_base (229)..(229): a, c, t, g, unknown or other
  modified_base (252)..(252): a, c, t, g, unknown or other
  modified_base (377)..(377): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctctgcaggcttcnggatacaccttcacccgcctactatatgcacgtgggtgccgtacgtcggccccgtaggacgaaggggtcttggaggtggagtgggatgggactccgacctaagaggtcggtaagacaagaaagtngacacgaggtaagtttcgagggtcgagggtacacgagtcggaaccgagggacaccgtaccatccgagccgacggtccatccgaacgaccacgacgacctaaccgatcggacctggacgccgggccttggaccacgtacgcgaaccggacgaccggtaaccgtaagttcgtttcgtagggttcgtaacgggaagggtaagg

SEQ ID NO: 402033 - DNA, 566 bp, Homo sapiens
  misc_feature: GZ8MTXP01D601Q.4.37.D04.1.454.CMB.2.raw
  modified_base (240)..(240): a, c, t, g, unknown or other
  modified_base (250)..(250): a, c, t, g, unknown or other
  modified_base (348)..(348): a, c, t, g, unknown or other
  modified_base (350)..(350): a, c, t, g, unknown or other
  modified_base (366)..(366): a, c, t, g, unknown or other
  modified_base (546)..(546): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggactggaggatcctcttcttggtggcagcagccacaggacgcccacctcccaggtgcagctggtgcagtcgtggggctggaggtgaagagccgtggggcctgagtgagtctcngcaaggcttntggatacaccttcaccgcctaactatatgcacgtgggtgccgacgtcggccccctaggacaagggcttagaggtggatgggatggactccgaacctangnggtgacaacgaaagtntcgacaacgaagtagtttcgagggcgagggtcacagtcgaacgagggacaccgtcatcgagccacggtacagtacgacgacaacgacgcctaacgacgtaccggacctggaaccggccgggtacttacggacgaacgtccgtaacggaccgaccgacggtaaccgtattaacgtttcggnggttcggaaggaaggtaagg

SEQ ID NO: 402034 - DNA, 511 bp, Homo sapiens
  misc_feature: GZ8MTXP01C5U00.4.37.D04.1.454.CMB.2.raw
  modified_base (503)..(503): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagccgtggggcctaagtgaaggtctcctgcaaggcttctggatacacctcaccgcctactatatgcactgggtgcgactggcccctggacaagggcttgagtggatgggatggatccgaccctaacagcggtggacaacaagtatgacacagaagtttcgagggcagggtcaccatcgacgaggacacgtcatcagcaccgtcatcagccacacgcctacatcggacctgacgcggcctgacacgttcgacgacgaacgcgaccgtaatacgttgtggtgcggtaaggnggtaaggg

SEQ ID NO: 402035 - DNA, 555 bp, Homo sapiens
  misc_feature: GZ8MTXP01CJGT4.4.37.D04.1.454.CMB.2.raw
  modified_base (546)..(546): a, c, t, g, unknown or other
  modified_base (549)..(549): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaggcttctggatacaccttcaccgcctactatatgcacgtgggtgcgacgtcggcccctggacaaggggctttggagtggatgggatggactcgacctaagaggcggtagggcaacgaaagtatggacaacgaggtaagtttcgaggggcgaggggtacaccgagtcggaaccgaggggacaccggtccaatcgacgccaaccggtccaatccgagaccaaccgacgacccttaacgacgtacggaacctggacggccgggcttggacagtcgacgacgcgacggtccgtatgttctggttcgnggnggaagg

SEQ ID NO: 402036 - DNA, 489 bp, Homo sapiens
  misc_feature: GZ8MTXP01AFIZL.4.37.D04.1.454.CMB.2.raw
  modified_base (422)..(422): a, c, t, g, unknown or other
  modified_base (474)..(474): a, c, t, g, unknown or other
  modified_base (480)..(480): a, c, t, g, unknown or other
  modified_base (482)..(482): a, c, t, g, unknown or other
  modified_base (484)..(484): a, c, t, g, unknown or other
  modified_base (486)..(486): a, c, t, g, unknown or other
  modified_base (488)..(488): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacacctcaccgcctactatatgcacgtgggtgcgactcggcccctggacagggtcttgagtggatgggatggatcccgacctagagcggtggaacaacaagtatgcacagtaagttcgagggcaggtcacgatgacgaggacacgtccatcagcacgtccatcagcacncgcctacagtcgacctgacgcggctgacagttcgagaacgcgcggctaattntcgtgngngngngng

SEQ ID NO: 402037 - DNA, 609 bp, Homo sapiens
  misc_feature: GZ8MTXP01BI4JX.4.37.D04.1.454.CMB.2.raw
  modified_base (229)..(229): a, c, t, g, unknown or other
  modified_base (254)..(254): a, c, t, g, unknown or other
  modified_base (353)..(353): a, c, t, g, unknown or other
  modified_base (372)..(372): a, c, t, g, unknown or other
  modified_base (592)..(592): a, c, t, g, unknown or other
  modified_base (604)..(604): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaaggcttcnggatacaccttcaccgcctactatatgcacgtgggtgcgacgtcggccccctaggaccgaagggctttggagtggagtgggatggactccgacctaagngcggtggacaacgaaagtntgacaacgtaggtaaacgtttcgaggggctacggggtaccaaccgagtacggaacccgaggggaaccaccggtaccagtccgaacggcctaccggggtacctaacgtaccgaacgccaaccgaccggtaccctaacgtaacgttccgggaacctcgggaggcccgggtcgttacgggaacaacgtccgaggaccgttcgacgggtcctagttctttcggnggttcgtaaggnggaag

SEQ ID NO: 402038 - DNA, 592 bp, Homo sapiens
  misc_feature: GZ8MTXP01AEMWN.4.37.D04.1.454.CMB.2.raw
  modified_base (229)..(229): a, c, t, g, unknown or other
  modified_base (247)..(247): a, c, t, g, unknown or other
  modified_base (570)..(570): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccaggtgcagctggtgcagtcgtggggctggaggtgaagagccgtgggcctnagtgagtctctgcagctntgatacacctcaccgtctactatatgcacgtgggtcgccgacgtcggccccctaggacgaaggggtctttaggaggtggagtggggatgggactcccgacctaagaggcggtaggacaacgaaagtatcgacaacgtaggtaacgtttcggacgggacgacgggtaccaccgtagacggaacccgaggggaaccaccggtaccagtaccgacgaccaccggggtaccactacgaacgacaccgacgaccctacgacgtcggacccgtggacggcccggcttggaccagtcgacgaccgacgccggtaacctattaacgttcgnggttagcgggttaagggtaagg

SEQ ID NO: 402039 - DNA, 496 bp, Homo sapiens
  misc_feature: GZ8MTXP01DXBAQ.4.37.D04.1.454.CMB.2.raw
  modified_base (223)..(223): a, c, t, g, unknown or other
  modified_base (248)..(248): a, c, t, g, unknown or other
  modified_base (282)..(282): a, c, t, g, unknown or other
  modified_base (355)..(355): a, c, t, g, unknown or other
  modified_base (434)..(434): a, c, t, g, unknown or other
  modified_base (461)..(461): a, c, t, g, unknown or other
  modified_base (484)..(484): a, c, t, g, unknown or other
  modified_base (490)..(490): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttcnggatacaccttcaccgctactatatgcatgggtncgactggcccctggacaagggcttgagtggatgggatggatcccgaccctaacgagcggtggacaacaaggtntgcaacaaggtaagttcgagggcagggtcaccatgaaccgagggacacgtccatcagcaacgtcatcagcacagcctanacgtgcctgacgcggctgacagttcgngacgagcggctaattatctgcgngaaggngtaagg

SEQ ID NO: 402040 - DNA, 542 bp, Homo sapiens
  misc_feature: GZ8MTXP01ELFHB.4.37.D04.1.454.CMB.2.raw
  modified_base (252)..(252): a, c, t, g, unknown or other
  modified_base (358)..(358): a, c, t, g, unknown or other
  modified_base (377)..(377): a, c, t, g, unknown or other
  modified_base (527)..(527): a, c, t, g, unknown or other
  modified_base (534)..(534): a, c, t, g, unknown or other
  modified_base (541)..(541): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtgggctgagtgaggtctcctgcaggtcttcgnggataccaccttcaccgtcctactatatgctacgtgggtcgcgacgtcggccccctagggacgaagggtcttaggaggtggagtgggatggactccgaacctaagnggcggtagacaagaaagtngacaacgagtagttcgagggcgagggtcaacgagtacgaacgagggacacgtacatcagcacggtcatcacgacaacgcgacctaacacgtcggacctggacggccggcttaggacagtcgacgacgacgacggtctattaacgttcggngttacgnggaaggng

SEQ ID NO: 402041 - DNA, 507 bp, Homo sapiens
  misc_feature: GZ8MTXP01DJK0I.4.37.D04.1.454.CMB.2.raw
  modified_base (222)..(222): a, c, t, g, unknown or other
  modified_base (407)..(407): a, c, t, g, unknown or other
  modified_base (417)..(417): a, c, t, g, unknown or other
  modified_base (448)..(448): a, c, t, g, unknown or other
  modified_base (493)..(493): a, c, t, g, unknown or other
  modified_base (504)..(504): a, c, t, g, unknown or other
  modified_base (506)..(506): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaaggtctcctgcaggcttctggatacacctcaccgcctactatatgcacgtggtgcgactcggcccctggacagggcttgagtggatggatggactccgaccctaagagcgtggacaacaaggtatggacaacagaagtttcgaagggcgaggcaccagtcgacgaagggacacgtccaancacgactacncactacacgacacgacgacacacgcgtacgngacgcgcacgacagttcgacgacgacgttcgacgttaatacttgngtgacgaaggngng

SEQ ID NO: 402042 - DNA, 539 bp, Homo sapiens
  misc_feature: GZ8MTXP01EP62C.4.37.D04.1.454.CMB.2.raw
  modified_base (244)..(244): a, c, t, g, unknown or other
  modified_base (268)..(268): a, c, t, g, unknown or other
  modified_base (339)..(339): a, c, t, g, unknown or other
  modified_base (359)..(359): a, c, t, g, unknown or other
  modified_base (427)..(427): a, c, t, g, unknown or other
  modified_base (452)..(452): a, c, t, g, unknown or other
  modified_base (481)..(481): a, c, t, g, unknown or other
  modified_base (519)..(519): a, c, t, g, unknown or other
  modified_base (532)..(532): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctgagtgaggtctctgcaggctngatactacctcaccgctactatangcacgtgggtgcgacgtcggcccctggacgagggtctggaggtggagtgggatggactccccgacctaagnggcggtgaaacaacgaagtntagaccaagtaaggtaacgtttcgagggtcgagggtaccacgagtacgaccgtagggacctacgtcancagacacgtcatcgacgacacgacnctacagtcgacctaggcgccggctagacncttcgacgacgacgcggttaccttaatacgttcgtggnggacgggtaaggngtaaggg

SEQ ID NO: 402043 - DNA, 591 bp, Homo sapiens
  misc_feature: GZ8MTXP01APIS4.4.37.D04.1.454.CMB.2.raw
  modified_base (229)..(229): a, c, t, g, unknown or other
  modified_base (254)..(254): a, c, t, g, unknown or other
  modified_base (347)..(347): a, c, t, g, unknown or other
  modified_base (366)..(366): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaaggcttgngatacaccttcaccgctactatatgcacgtgggtgccgacgtcggcccctggaccgaaggctttggagtggatgggatggactcgacctaagnggcggtagacaacaaagtnagacacaggtacgtttcgagggcgacggtacacgtagcgaaccgagggacacgtacacgtcgacgacaccgggtacacgtaccgacgaccaaccgacgaccctaacgtacgtaccgggtaaccgtcggaacgggcccgggaccgttacggaaccgacgtcggtaacggaccgttaccggacggtcccggttaatccgtttcgaggttcgaacgggaaggtaaggg

SEQ ID NO: 402044 - DNA, 607 bp, Homo sapiens
  misc_feature: GZ8MTXP01EQ6SI.4.37.D04.1.454.CMB.2.raw
  modified_base (245)..(245): a, c, t, g, unknown or other
  modified_base (365)..(365): a, c, t, g, unknown or other
  modified_base (588)..(588): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggcctgagtgagtctctgcaggctcnggatacaccttcaccgctactatatgcacgtgggcgcgacgtcggcccctagggacgaagggtcttggaggtggagtggggatggactccgaacctaagcggcggtagacaacgaaagtngacaaggtacggtaagtttcgagggtacgagggtacacgtagtacggaaccgacggggaactacccggtaccacgtaccgaacgcccgtaacgggtaccctaagtaccaacggacccaaacgaccggtaccctaaacgacggttacggaccgtacgggacgggaaccggtccgttaggaccgttacggacgtcgaacgttcgacggtccgtattaacgttcgnggttcgtcggaaggtaagg

SEQ ID NO: 402045 - DNA, 515 bp, Homo sapiens
  misc_feature: GZ8MTXP01DC17J.4.37.D04.1.454.CMB.2.raw
  modified_base (451)..(451): a, c, t, g, unknown or other
  modified_base (474)..(474): a, c, t, g, unknown or other
  modified_base (500)..(500): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctctgcaaggcttctggatacaccttcaccgcctactatatgcacgtgggtgcgactcggcccctggacagggcttgagtggatgggatggactccggaacctaacgaggcggtagggcaacgaaaagtatggcaacaggtaagtttcgaggggcaggggtcaccgagtcgaaccgagggacacgtccatcacgcacggtccatcagcacagctacntggacctgacgcggccttggacntcgtgaccgcacgggcctatcgtttnggttgcgaagggaag

SEQ ID NO: 402046 - DNA, 586 bp, Homo sapiens
  misc_feature: GZ8MTXP01AQHAQ.4.37.D04.1.454.CMB.2.raw
  modified_base (254)..(254): a, c, t, g, unknown or other
  modified_base (380)..(380): a, c, t, g, unknown or other
  modified_base (557)..(557): a, c, t, g, unknown or other
  modified_base (567)..(567): a, c, t, g, unknown or other
  modified_base (574)..(574): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctctgcaggtcttcgnggactaccaccttccaccgacctactatatcgcgtacgtggggtcgaccgtacgtccgggcccccgtagggaaccgtaaggggtcttaggaggtggagtggggatggacctaccggaccgtaacgnggcggtagacaacgaaagtatcgacaagagtaagtttcgaagggtcgacgggtacacagtacgaaccgaggaccacgtaccatcgacgccacggtacagtccacgacacgacgacctacgacgtcggacctggacggccgcgttggaccttacgtcgacgaccgcgaccgtaacgtnttaagttcgnggttagnggttaagggaag

SEQ ID NO: 402047 - DNA, 568 bp, Homo sapiens
  misc_feature: GZ8MTXP01EMS6G.4.37.D04.1.454.CMB.2.raw
  modified_base (334)..(334): a, c, t, g, unknown or other
  modified_base (357)..(357): a, c, t, g, unknown or other
  modified_base (379)..(379): a, c, t, g, unknown or other
  modified_base (542)..(542): a, c, t, g, unknown or other
  modified_base (561)..(561): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggggctggaggtgaagagccgtggggcctcagtgaaggtctctgcaaggcttctggatacaccttcacccgcctactatatgcacgtgggtgcgactcggcccctggacgaagggcttggaggtggagtaggggntaggacctccggaaccctaaagnggcggtagacaacgtaaagtangaccagtaaggtagtttcgagggcgacggggtcaacgtagcggaacccgagggaccaccggtaccatacgacgccaacgggtccaatccgagaccacgtacgacctacagtcggacctggacggcggcgttggacttacgtcgtacgacgcgaccgggtcctntaacgtttgagttcgcggnggtaagg

SEQ ID NO: 402048 - DNA, 558 bp, Homo sapiens
  misc_feature: GZ8MTXP01A27CS.4.37.D04.1.454.CMB.2.raw
  modified_base (252)..(252): a, c, t, g, unknown or other
  modified_base (351)..(351): a, c, t, g, unknown or other
  modified_base (370)..(370): a, c, t, g, unknown or other
  modified_base (536)..(536): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcagtgaaggtctctgcaaggcttcgnggatacaccttcacccgcctactatatgcacgtgggtgcgacgtcggcccctaggacgaagggtctttggagtggagtgggatggactccgacctaagngcggtagacaacgaaagtngacacgaggtaagtttcgagggcgagggtcacgagtgaaccgagggacacgtacagtcacgacgacggtccagtcacgaccacgacgacctacgacgtacggacctggacgccggccttaggacttcgtaccgtacggacgaccgacggtccgtattaactttcgnggttacggcggaaggggtaagg

SEQ ID NO: 402049 - DNA, 545 bp, Homo sapiens
  misc_feature: GZ8MTXP01EKZ7Q.4.37.D04.1.454.CMB.2.raw
  modified_base (228)..(228): a, c, t, g, unknown or other
  modified_base (251)..(251): a, c, t, g, unknown or other
  modified_base (383)..(383): a, c, t, g, unknown or other
  modified_base (442)..(442): a, c, t, g, unknown or other
  modified_base (531)..(531): a, c, t, g, unknown or other
  modified_base (539)..(539): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctnagtgaaggtctctgcaggcttcnggatacaccttcaccgcctactatatgcacgtgggtgccgtacgtcggccccctagggaccgtaagggggtctttaggaggtggagtggggatggaactccggaacctaagaggcggtagaccaagaaagtntgacaacgaaggtaaagtttcgagggcgagggtcacgagtacgacgagggacacgtcancagcacggtcatcacgacacgacgacctaacagtacggaccgtggacgccggcgttggacacgtcgacgacgacgacgtcgtatcttgngttgtggnggaagg

SEQ ID NO: 402050 - DNA, 565 bp, Homo sapiens
  misc_feature: GZ8MTXP01CNV8C.4.37.D04.1.454.CMB.2.raw
  modified_base (225)..(225): a, c, t, g, unknown or other
  modified_base (423)..(423): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcgtgggctnagtgaggtctctgcaggcttctggatacaccttcaccgcctactatatgcactgggtcgcgacgtcggccccctaggacgaagggcttggagtggagtgggatggactcgaacctacgagcggtggacaacgaaagtcaggaccagaagtaacgttcgagggacagggacaccgatacgaaccgagggactacgccancgagcacgtacatacacgacacgacgacctaacgacgtacggaccgtaggaccggccggtaccgacggaaccaacggtaccgaacgaacgttaccggaccggtaacgtattaacgttcgtaggttacggtcggaaggtaagg

SEQ ID NO: 402051 - DNA, 529 bp, Homo sapiens
  misc_feature: GZ8MTXP01CJTKM.4.37.D04.1.454.CMB.2.raw
  modified_base (251)..(251): a, c, t, g, unknown or other
  modified_base (467)..(467): a, c, t, g, unknown or other
  modified_base (515)..(515): a, c, t, g, unknown or other
  modified_base (519)..(519): a, c, t, g, unknown or other
  modified_base (521)..(521): a, c, t, g, unknown or other
  modified_base (525)..(525): a, c, t, g, unknown or other
  modified_base (528)..(528): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcacgtgggtgcgacgtcggccccctggacgaagggtctttggagttggatgggatggactccggacctaagaggcggtagggacaacgaaaagtatggacacgaggtaaagtttcgaggggtcgaggggtcaaccgatggaccgagggacacgtaccatcagcacggtcagtcagcacacgacctacgntcggaccgtgacgcgggaccttgaccagcgtagacgacgacgcgtatnttgngngcgnggng

SEQ ID NO: 402052 - DNA, 541 bp, Homo sapiens
  misc_feature: GZ8MTXP01BC7AO.4.37.D04.1.454.CMB.2.raw
  modified_base (226)..(226): a, c, t, g, unknown or other
  modified_base (249)..(249): a, c, t, g, unknown or other
  modified_base (332)..(332): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaggtctcctgcaggcttcnggatacaccttcaccgcctactatatgcacgtgggtcgcgacgtcggcccctggacaagggcttggagtggatgggatggacncgacctaagagcggtagacaacgaaagtagtcgacacgaagtacgtttcgagggtcgagggtcacgatacgaccgagggacacgtcatcagcacggtccatcacgcacacgaccacagtcggaccgtgacgcggtccacggacacgtcacgaaccgttcgaccgggtaaccttattaacgtttcgtggttggtaacggaagggtaaggg

SEQ ID NO: 402053 - DNA, 571 bp, Homo sapiens
  misc_feature: GZ8MTXP01EIC5D.4.37.D04.1.454.CMB.2.raw
  modified_base (228)..(228): a, c, t, g, unknown or other
  modified_base (252)..(252): a, c, t, g, unknown or other
  modified_base (531)..(531): a, c, t, g, unknown or other
  modified_base (556)..(556): a, c, t, g, unknown or other
  modified_base (562)..(562): a, c, t, g, unknown or other
tcagagcactgtagcacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctctgcaaggcttcnggatacaccttcaccgcctactatatgcacgtgggtgcgacgtcggcccctaggacgaaggggtctttaggaggtggagtggggatggactccggaacctaagaggcggtaggacaacgaaagtatcggacaacgaaggtaagtttcgagggtacgaggggtcaacgagtacggaaccgaaggggaccaccggtaccaactacgaacgccgaaccggtaccaagtccaagaccaacgacgcctaacagtcggaacctggacgcggccttggacagtcgngacgacgacggtcgtataagttcgngttcgnggaaggaag

SEQ ID NO: 402054 - DNA, 598 bp, Homo sapiens
  misc_feature: GZ8MTXP01BIEP8.4.37.D04.1.454.CMB.2.raw
  modified_base (505)..(505): a, c, t, g, unknown or other
  modified_base (579)..(579): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagcctggggcctcagtgaaggtctcctgcaaggcttctggatacacccttcaccgcctactatactgcacgtggggtcgcgacgttcgggccccttagggacgaaggggtctttaggaggtggagtggggatgggactaccggaacctaacgaggcgggtaaggctaacgaaaggtatcgggactaacgaaggtaaacgttttcgaacggggtcgacggggtaccaaccgtagtacggaaccgagggaccacggtccagtcagccacggtccatcagcaacgacgcctaacngtcggactcggacggccggcttacggacttcgtcgtacgaccgacgttacgggtaaccgttattaacgtttcgnggttagcggaagggtaagg

SEQ ID NO: 402055 - DNA, 524 bp, Homo sapiens
  misc_feature: GZ8MTXP01AIX0H.4.37.D04.1.454.CMB.2.raw
  modified_base (252)..(252): a, c, t, g, unknown or other
  modified_base (372)..(372): a, c, t, g, unknown or other
  modified_base (498)..(498): a, c, t, g, unknown or other
  modified_base (514)..(514): a, c, t, g, unknown or other
  modified_base (517)..(517): a, c, t, g, unknown or other
  modified_base (519)..(519): a, c, t, g, unknown or other
  modified_base (521)..(521): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctctgcaaggcttcnggatacaccttcaccgcctactatatgcacgtgggtgcgactcggccccctggacaaggggctttggaggtggatggggatggactccggaacctaagaggcggtaggacaacgaaagtngcaacgtagtaaacgtttcgagggcagggtcaaccgagtcgaaccgagggacacggtaccatcagcacggtcatcacgcacgagcctaacagtcggacctgaggcggccgttggaccaagtcccgngacgacgcggcatctntgngngngng

SEQ ID NO: 402056 - DNA, 613 bp, Homo sapiens
  misc_feature: GZ8MTXP01A0LTS.4.37.D04.1.454.CMB.2.raw
  modified_base (259)..(259): a, c, t, g, unknown or other
  modified_base (389)..(389): a, c, t, g, unknown or other
  modified_base (476)..(476): a, c, t, g, unknown or other
  modified_base (593)..(593): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgacgaaggtcttcgnggataccaccttcacccgctactatatgctacgtgggtcgacgaccgtcggaccccgtaggaacgaacgggtcttggagtggagtgggagtggactccgaacctagaggtcggtaagacaacgtaaagtntcgacacgtagtaacgttcgagggcagggtaccacgatacggaaccgagggaccaccggtacacgtacacggaccacggggtccaanaccgacaccgaaccacgtaccctaaacgtacggttaccgggaaccgttcggggaaacgtcccgggcttacgggaccttacgtcgtacgacgacgacggtaaccgtagtctttagggnggacggaacggaagggtaag

SEQ ID NO: 402057 - DNA, 519 bp, Homo sapiens
  misc_feature: GZ8MTXP01EBZ7L.4.37.D04.1.454.CMB.2.raw
  modified_base (227)..(227): a, c, t, g, unknown or other
  modified_base (252)..(252): a, c, t, g, unknown or other
  modified_base (364)..(364): a, c, t, g, unknown or other
tcagagcactgtagcacgaccggtgctcgatttagtagcatactgttgggtttgggggagcatcacccagcaaccacatctgtcccctagagaatcccctgagagctccgttcctcaccatggactggacctggaggatcctcttcttggtggcagcagccacaggagcccactcccaggtgcagctggtgcagtctggggctggaggtgaagagccgtggggcctnagtgaaggtctcctgcaaggcttcnggatacacctcaccgcctactatatgcactgggtgcgactggcccctggaacagggtcttggagtggagtgggatggactcccgaccctaagaggcggtggaacaacaagtntagacacgagtaagtttcgagggcaggtcacatcgacgagggacacgtcatcagcacgtcatcagcacacgcctacgagtcggacctgacggcggctgactagttcgacgacgacgcgttacgtaatagttcgtgtggacggaagggaagtaagg

SEQ ID NO: 402058 - DNA, 533 bp, Homo sapiens
  misc_feature: GZ8MTXP01EEM7B.4.37.D04.1.454.CMB.2.raw
  modified_base (225)..(225): a, c, t, g, unknown or other
  modified_base (246)..(246): a, c, t, g, unknown or other
  modified_base (520)..(520): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagcgtgggctnagtgagtctctgcaggcttcnggatacaccttcaccgctactatatgcacgtgggtgcgacgtcggccccgtaggaccgaagggctttggaggtggagtggggatggactccggaacctagaggcggtaggacaacgtaaagtatggacaacgaggtaaagtttcgagggcgagggtcaccgagtagaccgagggacacgtcatcacgcacggtcatacacgcacacgctacagtcgacctggacgcgggccttaggaccagtcgcgacgttacacgggtcctattaactttcgngacgtggaaggtg

SEQ ID NO: 402059 - DNA, 544 bp, Homo sapiens
  misc_feature: GZ8MTXP01DLQKQ.4.37.D04.1.454.CMB.2.raw
  modified_base (229)..(229): a, c, t, g, unknown or other
  modified_base (296)..(296): a, c, t, g, unknown or other
  modified_base (391)..(391): a, c, t, g, unknown or other
  modified_base (513)..(513): a, c, t, g, unknown or other
  modified_base (533)..(533): a, c, t, g, unknown or other
  modified_base (535)..(535): a, c, t, g, unknown or other
  modified_base (540)..(540): a, c, t, g, unknown or other
  modified_base (543)..(543): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaaggcttcgtggatacaccttcaccgcctaactatatcgctacgtgggtcncgacgtcgggccccctagggaacgaaggggtctttaggaggttggaagtggggatcggactcccggaacctaagaggcggtagacaacgaaagtntagacacgaggtaagttcgagggcgagggtacacgatacggaacgagggacacgtcatcagccacggtcatcagacactacgcctaagacgtcggacctggacggtcggcttggacagtcgngacgcgacgtctatcgttgngngcggnggng

SEQ ID NO: 402060 - DNA, 563 bp, Homo sapiens
  misc_feature: GZ8MTXP01AQ3HO.4.37.D04.1.454.CMB.2.raw
  modified_base (254)..(254): a, c, t, g, unknown or other
  modified_base (551)..(551): a, c, t, g, unknown or other
  modified_base (553)..(554): a, c, t, g, unknown or other
  modified_base (556)..(556): a, c, t, g, unknown or other
  modified_base (558)..(558): a, c, t, g, unknown or other
  modified_base (560)..(560): a, c, t, g, unknown or other
  modified_base (562)..(562): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctcctgcaaggcttcnggatacaccttcacccgcctactatatgctacgtgggtcgcgacgtcggcccctggacaaggggtcttggagtggagtggggatgggacctcggacctaagaggcggtagacaacgaaaggtatgaccgaactaaggtaaagttttccggagggacgtacggggtaccaaccgagtacggaacccgaggggaaccaccggtccagtaccaggaccaccggggtccaatccgacgaccacgacgcctacgacgtcggacctggacggcggcgttggacgaggcgcgagttcgagctangnngngngngng

SEQ ID NO: 402061 - DNA, 586 bp, Homo sapiens
  misc_feature: GZ8MTXP01AW5YR.4.37.D04.1.454.CMB.2.raw
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacacctcaccgcctactatatgcactgggtgcgactcggcccctggacaagggcttgagtggatgggatggatccgaccctaagagcggtgacaacaagtatgacacagtaagtttcgaagggcgaggggtacaaccgagtacgaacccgacggggaacaccggtaccaagttcaacgccaaccggtccgaactcgagaccacgacgccctaacgacgtcggaccctggaaccggcgggccgtacggaccgaaacggttccgtacgtaacgttaaaccgcgggttaccgtaattacctttcggtacggtacggacggtaacgggaaggtaagg

SEQ ID NO: 402062 - DNA, 562 bp, Homo sapiens
  misc_feature: GZ8MTXP01DXGN0.4.37.D04.1.454.CMB.2.raw
  modified_base (228)..(228): a, c, t, g, unknown or other
  modified_base (249)..(249): a, c, t, g, unknown or other
  modified_base (272)..(272): a, c, t, g, unknown or other
  modified_base (349)..(349): a, c, t, g, unknown or other
  modified_base (541)..(541): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtggggcctnagtgaggtctctgcaggcttnggatacacctcaccgctatatangcagtgggtgcgacgtcggacccctagggacgaaggggtcttggaggtggagtggggatggacctccgaacctaagngcggtagacaacgaaagtagcgacagaaggtaagtttcgagggtacgagggtacacgagtacgaccgagggacacgtcagtcacgcacggtcatacacgacaacgacgtacctacacgtcggaccgtcggacggccggtccttaggaccgacgtccgtacgaaccgcgaccggtaacgtataacgtttcggngttacggaacggaagggtaag

SEQ ID NO: 402063 - DNA, 614 bp, Homo sapiens
  misc_feature: GZ8MTXP01BDONF.4.37.D04.1.454.CMB.2.raw
  modified_base (227)..(227): a, c, t, g, unknown or other
  modified_base (386)..(386): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaaggtctcctgcaaggtcttctggaatacacccttcaaccgtcctaactatatcgactacgttggggtgccgtacgtcgggacccccgtgggaccgtaagggggtcctttaggaggttggaagtgggggaatcggggacttccggaaccctaagnggtccgggtaagcaacaaaggtactggacctacgaagtaacgtttcgacgggcgagggtcacgataggaccgaaggggacaccgtcactcagccacgggtaccagtcacgcaccgacgacctaacgagtcggaccgtcggaacggccgggcttaggaccttaagtccgtcgaacgttaccgacggaaccgttataacgtttcgttagttacgtaacgggaaggtaagg

SEQ ID NO: 402064 - DNA, 569 bp, Homo sapiens
  misc_feature: GZ8MTXP01ELK77.4.37.D04.1.454.CMB.2.raw
  modified_base (247)..(247): a, c, t, g, unknown or other
  modified_base (256)..(256): a, c, t, g, unknown or other
  modified_base (258)..(258): a, c, t, g, unknown or other
  modified_base (266)..(266): a, c, t, g, unknown or other
  modified_base (317)..(317): a, c, t, g, unknown or other
  modified_base (434)..(434): a, c, t, g, unknown or other
  modified_base (436)..(436): a, c, t, g, unknown or other
  modified_base (438)..(438): a, c, t, g, unknown or other
  modified_base (440)..(440): a, c, t, g, unknown or other
  modified_base (442)..(442): a, c, t, g, unknown or other
  modified_base (446)..(446): a, c, t, g, unknown or other
  modified_base (448)..(448): a, c, t, g, unknown or other
  modified_base (450)..(450): a, c, t, g, unknown or other
  modified_base (452)..(452): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaggtctctgcaggctngatcactcncnctactatntgcacgtggtgcgcgtcgccgtacgacgaggcgtgtaggtggtagtggtanaggaccgtaccgtaccgtaacgacgacgggtacggacgaacgtaaagtatagacagacggtaagttacgagggtcgacgggtaccgaccgacgtacgacgacgggaacgtaccgccncncncncncgcncncncncgacgcgacgacacgtaccaccgaccgaccgaaccgtaccgaccgtaccgacgtaccgtcgacgccgacgaaccgtacgtaacgtaccgtaccgttaccgtaaccgttaacgtaacg

SEQ ID NO: 402065 - DNA, 580 bp, Homo sapiens
  misc_feature: GZ8MTXP01DRCV5.4.37.D04.1.454.CMB.2.raw
  modified_base (568)..(568): a, c, t, g, unknown or other
  modified_base (579)..(579): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcagtgaaggtctctgcaggtcttctggatacaccttcaccgcctactatatgcacgtgggtgcgacgtcggcccctgggacgaagggtctttggaggtggagtggggatcggacctccggaacctaagcggtcggtaaggacaacgaaagtatacgacaacgaggtaaacgtttcgaggggcaggggtcaacgagtacgaaccgagggacaccgtccaagtccaacgccaacgggtacccagtaccaacgccaacgacgacctaacgacgtcgggacctggaccggtaaccgggtcttagggaaccagtccgagaacgttcgacggtctattaacttcgngcgcggaaggng

SEQ ID NO: 402066 - DNA, 554 bp, Homo sapiens
  misc_feature: GZ8MTXP01BKJFZ.4.37.D04.1.454.CMB.2.raw
  modified_base (292)..(292): a, c, t, g, unknown or other
  modified_base (304)..(304): a, c, t, g, unknown or other
  modified_base (394)..(394): a, c, t, g, unknown or other
  modified_base (542)..(542): a, c, t, g, unknown or other
  modified_base (550)..(550): a, c, t, g, unknown or other
  modified_base (553)..(553): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagacgccgtggggcctcgagtagaaggtctccgtgacaaggtcttcgtggactaccaccttcacccgtcctaactatangcacgtggggtnccgtactcgggccccctaggacgaagggtctttaggaggtggagtggggatggacctccgaaccgtagacggcggtagacaacgaaagtngacagagtaagttcgagggtcgagggtcacgagtgaccgagggacacgtcacgcacgccacggaccatacgacgcaaccacgacctacacgtacggaccgtgaccggcgggcttcgggaacttgcgacgacgcgcggtctatgtcggnggcgtggnggng

SEQ ID NO: 402067 - DNA, 521 bp, Homo sapiens
  misc_feature: GZ8MTXP01AGT7B.4.37.D04.1.454.CMB.2.raw
  modified_base (502)..(502): a, c, t, g, unknown or other
  modified_base (511)..(511): a, c, t, g, unknown or other
  modified_base (518)..(518): a, c, t, g, unknown or other
  modified_base (520)..(520): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgtggatacaccttcacccgcctactatatgcacgtgggtgcgactcggcccctggacagggcttggagtggatgggatggactcgacctaagaggcggtggcaacaaagtatgacaacgaggtaaacgtttcgaggggcaagggtcaccgagtcgaaccgaggggaccacgtaccagtcagccacggtcatcagcacagcctacagtcggacctggagcgggcttgggacttaagcgacgacgcgcggctntaattcggngttgcgngng

SEQ ID NO: 402068 - DNA, 519 bp, Homo sapiens
  misc_feature: GZ8MTXP01BYET4.4.37.D04.1.454.CMB.2.raw
  modified_base (342)..(342): a, c, t, g, unknown or other
  modified_base (359)..(359): a, c, t, g, unknown or other
  modified_base (436)..(436): a, c, t, g, unknown or other
  modified_base (462)..(462): a, c, t, g, unknown or other
  modified_base (511)..(511): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctctgcaaggcttctggatacaccttcacccgcctactatatgcactggggtgcgactcggcccctggacgagggctttggagtggatggggatggactcgacctagngcggtgacaacaaagtngcacaggtagtttcgagggcagggtcacagtgaaccgaggacacgtcatcagcacggtcatccagcacacgcctacngtcggacctgacgccggcttggaccngtctcggacgttacgaccgggtccgttattaactttcgtggttggcggnggggtaag

SEQ ID NO: 402069 - DNA, 575 bp, Homo sapiens
  misc_feature: GZ8MTXP01AUEQ0.4.37.D04.1.454.CMB.2.raw
  modified_base (256)..(256): a, c, t, g, unknown or other
  modified_base (291)..(291): a, c, t, g, unknown or other
  modified_base (379)..(379): a, c, t, g, unknown or other
  modified_base (560)..(560): a, c, t, g, unknown or other
tcagagcactgtagcacgaccggtgctcgatttagtagcatactggttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtcgtggggctggaggtgaagaagccgtggggcctcagtgaaggtctcctgcaggcttcgnggatacaccttcaccgctactatatgcagtgggtncgacgtcggcccctaggacgaaggggtctttggacggtggagtgggatggactccgaacctagaggtcggtaacggacaacgaaagtntagacacgaggtaaacgtttcgagggacgtaaggggtacaacgaagtacggaaccgaacggggaccaccggtaccatacgacgacaccgggtcaatcgaacgacgacacgacctaacacgtacggactcggacgcgggccttaggacagtccgagacgcgacggtaacgtattcgttcggngttagtcggaaggtg

SEQ ID NO: 402070 - DNA, 625 bp, Homo sapiens
  misc_feature: GZ8MTXP01A0U15.4.37.D04.1.454.CMB.2.raw
  modified_base (252)..(252): a, c, t, g, unknown or other
  modified_base (617)..(617): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctctgcaggcttcnggatacacctcaccgctactatatgcacgtgggtgcgactcggcccctggaccgaagggtcttggaggtggagtggggagtagggactaccgaccgtaaacgagggccggtagggacaacgaaaggtactgacaacgaagggtaacgttttcggagggtacgtagggggtcaacgtagtacggaaccggagggaccaccggtaccacgtaccgacgacccgaccgggtaccaacgtccgaacggaccaaccgacgacccgttaacacgtcggaccgtacgggacggccgggtaccgttggaaccgttagtaccgaccggaacgttccggacgggtaacccgttattgttcggaggttacggcggngggtaagg

SEQ ID NO: 402071 - DNA, 504 bp, Homo sapiens
  misc_feature: GZ8MTXP01AMUZT.4.37.D04.1.454.CMB.2.raw
  modified_base (336)..(336): a, c, t, g, unknown or other
  modified_base (350)..(350): a, c, t, g, unknown or other
  modified_base (356)..(356): a, c, t, g, unknown or other
  modified_base (381)..(381): a, c, t, g, unknown or other
  modified_base (423)..(423): a, c, t, g, unknown or other
  modified_base (492)..(492): a, c, t, g, unknown or other
  modified_base (501)..(501): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcagcttctggatacacctcaccgcctactatatgcacgtggtgcgactcggcccctggacgaagggtcttagagtggagtggatggatcccgacctangcggtgacacaagntgacanagtagttcgaggcagggtcacgtancgaccgagggacacgtaccatcgagcacgtcatcgagacacncgcctacagtcggacctgacgccggtcgacgactagttcgacgacgttaccgcgaccgtaatgttcggngcgagtggngtg

SEQ ID NO: 402072 - DNA, 487 bp, Homo sapiens
  misc_feature: GZ8MTXP01AFGBR.4.37.D04.1.454.CMB.2.raw
  modified_base (252)..(252): a, c, t, g, unknown or other
  modified_base (343)..(343): a, c, t, g, unknown or other
  modified_base (358)..(358): a, c, t, g, unknown or other
  modified_base (419)..(419): a, c, t, g, unknown or other
  modified_base (445)..(445): a, c, t, g, unknown or other
  modified_base (472)..(472): a, c, t, g, unknown or other
  modified_base (476)..(476): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (484)..(484): a, c, t, g, unknown or other
  modified_base (486)..(486): a, c, t, g, unknown or other
tcagagcactgtagcacgaccggtgctcgatttagtagcatactgttgtgtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctcctgcaaggcttcgnggataccaccttcaccgcctactatatgcacgtgggtgcgactcggcccctggacgaagggcttgagtgatgggatcggatcgacctaagngcggtgcacaaagtntgacacagtaagttcgaggcagggtcacagtcgacgaggacacgtcatcgagcacgtccancacgcacacgacctagtcgcgaccgnggaacgcggctgacgagcgagcgacgngctntntngngngng

SEQ ID NO: 402073 - DNA, 645 bp, Homo sapiens
  misc_feature: GZ8MTXP01D1Z6P.4.37.D04.1.454.CMB.2.raw
  modified_base (252)..(252): a, c, t, g, unknown or other
  modified_base (259)..(259): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctgagtgaaggtctctgcaggtcttgnggatacnccttcaccgctaactatatcgcacgtgggtcgccgacgtccgggcccctagggaccgaaggggtcttaggaggtggagtggggatcgggactccggaccgtaagcggtcgggtagacaagtaaagtgtagcgaaggaagtagtttcgagggcgtagggtacagtagtcgaaccgagggaccacgtacacgtacgacgcctaacggggcctaacgtaccaacggaccaacgaccgtaccgtaaacgtaggtaccggtaaccgtcgggaccggccgggtaccgttacggaaccttacgttaccgacgggaccgttaaaccggttacccgggtaaccgtttattaacgggttttccgtagggttacggaacggggttaaggggtaaggg

SEQ ID NO: 402074 - DNA, 588 bp, Homo sapiens
  misc_feature: GZ8MTXP01BRW7I.4.37.D04.1.454.CMB.2.raw
  modified_base (252)..(252): a, c, t, g, unknown or other
  modified_base (378)..(378): a, c, t, g, unknown or other
  modified_base (563)..(563): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcagtgaggtctctgcaggcttgnggatacaccttcaccgcctatatatgctacgtgggtgccgacgtcggccccgtaggacgaagggtcttggaggtggagtggggatcggactccggaacctaagacggcggtaagaacaagaaagtngacaagaggtaagtttcgagggacgagggtacaccgagtacggaaccgagggaccacggtccagtcagccacggtcagtcacgaccacgacgacctacgagtccggacccgtgggaccggccgggtccgttagggaccgacggtccgacggaaccggacgaccgggtccgttaattcgtttcggnggttacgggtaacgggaagggtaag

SEQ ID NO: 402075 - DNA, 567 bp, Homo sapiens
  misc_feature: GZ8MTXP01EWVCS.4.37.D04.1.454.CMB.2.raw
  modified_base (302)..(302): a, c, t, g, unknown or other
  modified_base (369)..(369): a, c, t, g, unknown or other
  modified_base (391)..(391): a, c, t, g, unknown or other
  modified_base (563)..(563): a, c, t, g, unknown or other
  modified_base (566)..(566): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgagtggaaggtctccgtgcaaggcttcgtggacttaccacccttcacccgcctaactatatgcacgtggggtcnccgacgtcggccccgtaggacgaaggggtcttggagtggagtggggatggactcccggaacctaagnggtcggaggacaacgtaaagtntcgacaacgtaggtaacgttcgagggtcgagggccacagtcgaacgaggacacgtcatcgagaccacggtacagtccacgacacacgtacctaacgacgtcggacctgggccggaacggtcgttcgggacttacggtcgacgacgcgacgggtctatcgttgtggcgtcggnggng

SEQ ID NO: 402076 - DNA, 654 bp, Homo sapiens
  misc_feature: GZ8MTXP01ES3GD.4.37.D04.1.454.CMB.2.raw
  modified_base (289)..(289): a, c, t, g, unknown or other
  modified_base (634)..(634): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggtcttctggatacaccttcaccgctactatatgcacgtgggngcgacgtcggcccctggaccgagggtcttggagtggagtgggatggactaccgacctaagacggcggtaggacaacgaaaagtatacggacaacgtaaggtaaacgttttacggacggggtacgtaggggtacccaacccgtaagtacgggaaacccggaaggggtaacccaaccggttcccaagtaccgaacggacccgtaaccggggtaccctaacgtaccgaacggaccaaccgaccgtacccttaacgacggttcgggaaaccccgtgggaaccggccgggtacccgttcggaaccgacgttaccgcggaacgttcgaccggtaacgtacttaagttcggnggttcggaacggaaggtaag

SEQ ID NO: 402077 - DNA, 522 bp, Homo sapiens
  misc_feature: GZ8MTXP01C8EWU.4.37.D04.1.454.CMB.2.raw
  modified_base (447)..(447): a, c, t, g, unknown or other
  modified_base (474)..(474): a, c, t, g, unknown or other
  modified_base (515)..(515): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccgcctactatatgcacgtgggtgccgacgtcggccccctggacaaggggctttggagtggatggggatggactccgacctagagcggtaggcaacaaagtatgcaacagtaagtttcgaggggcaggggtcacgatacggaacgaggggacaccggtcaatcagccacgggtcatccagcacncgcctacatggacctggacgcgggtcnggacagtcgcgaacgcgaccgggtctatgttctgttgcggnggtaagg

SEQ ID NO: 402078 - DNA, 587 bp, Homo sapiens
  misc_feature: GZ8MTXP01DPWGW.4.37.D04.1.454.CMB.2.raw
  modified_base (403)..(403): a, c, t, g, unknown or other
  modified_base (464)..(464): a, c, t, g, unknown or other
  modified_base (478)..(478): a, c, t, g, unknown or other
  modified_base (487)..(487): a, c, t, g, unknown or other
  modified_base (498)..(498): a, c, t, g, unknown or other
  modified_base (567)..(567): a, c, t, g, unknown or other
  modified_base (570)..(570): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctgagtgaaggtctccgtgacgaaggtcttcgtggaactaccacccttcacccgtcctaactatatcgctacgtgggtcgccgaccgtcgggccccctagggacgaaggggtctttggaggtggagtggggataggacctaccggaaccgtaagcggcgggtagacaacgaaagtntgaccaagaaggtaagttcgagggcgtagggacacgagacgaaccggaggacacgtaccancaagccacggctancagccaacncgacctaacgngtcggaacctggacggccggccaggaacttgtaccgtacgaaccgcgaccgggtctattaacgtttcgnggngaacgggaagggtaagg

SEQ ID NO: 402079 - DNA, 619 bp, Homo sapiens
  misc_feature: GZ8MTXP01EAK2N.4.37.D04.1.454.CMB.2.raw
  modified_base (230)..(230): a, c, t, g, unknown or other
  modified_base (395)..(395): a, c, t, g, unknown or other
  modified_base (549)..(549): a, c, t, g, unknown or other
  modified_base (596)..(596): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctnagtgaaggtctcctgcaaggtcttcgtggactacaccttcaccgtcctaactatatcgcacgtgggtcgccgtacgtccgggacccctagggaacgtaaggggctttaggagtggagtggggatcggactccggaacctaagaggcgggtaagacaacgaaagtntacggacaagaaggtaacgtttacgacggggacgtaacggggtacaaccgatacggaaccggaacgggaaccacggtacaacacgagaccacgggtcaacgtccaacgccaacgacgtacctaacgagtacgggacctggaacggccgggtacngggtaaccaggtcctacggaacgcgaccggtcgttacttgtttcggnggttacggtaacggaagggtaag

SEQ ID NO: 402080 - DNA, 547 bp, Homo sapiens
  misc_feature: GZ8MTXP01CQNCB.4.37.D04.1.454.CMB.2.raw
  modified_base (361)..(361): a, c, t, g, unknown or other
  modified_base (382)..(382): a, c, t, g, unknown or other
  modified_base (508)..(508): a, c, t, g, unknown or other
  modified_base (531)..(531): a, c, t, g, unknown or other
  modified_base (533)..(533): a, c, t, g, unknown or other
  modified_base (535)..(535): a, c, t, g, unknown or other
  modified_base (537)..(537): a, c, t, g, unknown or other
  modified_base (539)..(540): a, c, t, g, unknown or other
  modified_base (542)..(542): a, c, t, g, unknown or other
  modified_base (544)..(544): a, c, t, g, unknown or other
  modified_base (546)..(546): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagaagccgtggggctcgagtgaaggtctcctgacaggtcttcgtggatacaccttcaccgtcctactatatgctacgtgggtcgcgacgtcggcccctaggacgtaagggctttggaggtggagtgggatggacctccggaacctacgnggcgggtagaccaagaaagtntacgacacgaagtaaggttcgaaggggtcaagggtcaacgagacgaccggacgggacacgtaccagacacgaccacggtacccagccaagccaacacgactacagtcggacgtcgaggccggtacncgggacaggccagttaacgcggngntngngnngngngng

SEQ ID NO: 402081 - DNA, 545 bp, Homo sapiens
  misc_feature: GZ8MTXP01B1V37.4.37.D04.1.454.CMB.2.raw
  modified_base (225)..(225): a, c, t, g, unknown or other
  modified_base (243)..(243): a, c, t, g, unknown or other
  modified_base (278)..(278): a, c, t, g, unknown or other
  modified_base (344)..(344): a, c, t, g, unknown or other
  modified_base (366)..(366): a, c, t, g, unknown or other
  modified_base (480)..(480): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggctnagtgagtctctgcagctngactacacctcaccgctactatatgctagtgggtnccgacgtcggccccgtaggacgagggtcttggaggtggagtggggatggacctaccggacctaagngggcggtagaccaacgaaagtngaccagaggtaacgtttcgagggcgacgggtcacgtagacgaacgagggtacacgtacactcagccacggtcactcacgcacgacgacctacgcgtcggaccgtgacgcggccngacagtcgtacgaccgacgacggtaaccgttagttcgttcgtggttcggaacgggaagggtaagg

SEQ ID NO: 402082 - DNA, 558 bp, Homo sapiens
  misc_feature: GZ8MTXP01AX9ZR.4.37.D04.1.454.CMB.2.raw
  modified_base (231)..(231): a, c, t, g, unknown or other
  modified_base (368)..(368): a, c, t, g, unknown or other
  modified_base (539)..(539): a, c, t, g, unknown or other
  modified_base (547)..(547): a, c, t, g, unknown or other
tcagagcactgtagcacgaccggtgctcgatttagtagcatactggttggggtttggggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagcctggggcctnagtgaaggtctctgcaaggcttctggatacaccttcaccgcctactatatgcacgtgggtgcgactcggcccctaggacaagggctttaggagtggaatgggatggactcgacctaagagcggtaggcaacaaagtntgacaacagaagtttcagggcagggtcaaccatagaacgagggacacgtaccatcagaccacgggtaccaatccaagaccaaacacggacctaaaccgagttcggaacccgtggaacggccgggccttcggaacacgtacgacgacgaacgacggtccgtaatctttacgngttacggnggaagggtaag

SEQ ID NO: 402083 - DNA, 606 bp, Homo sapiens
  misc_feature: GZ8MTXP01AJMSD.4.37.D04.1.454.CMB.2.raw
  modified_base (251)..(251): a, c, t, g, unknown or other
  modified_base (254)..(254): a, c, t, g, unknown or other
  modified_base (257)..(257): a, c, t, g, unknown or other
  modified_base (357)..(357): a, c, t, g, unknown or other
  modified_base (379)..(379): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggatgatcctcttcttggtggcagcagccacaggagcccactcccaggtgcagctggtgcagtcgtggggctggaggtgaagaagccgtggggcctcgagtgaggtctctgcaggcttnganacnccttcaccgctactatatgctacgtggggtcgccgacgtcggcccctgggacgaagggtcttggaggtggagtggggatcggactcggaacccgtaacgnggacgggtgaacaacgaaagtntcgacaacgtagtaaagttcgagggacgagggtaccacgagtacggaccgagggaccaccgtacactacgacgaccgtacgtccataccgacgaccacgacgtaccctacgacgtacggaccgtggaacggccggttacctacggaccgtaagtccgttacggaaccgttaccggtaaccgggtacgttaactttacgttcggttaggttgggaacgggtaaggggg

SEQ ID NO: 402084 - DNA, 519 bp, Homo sapiens
  misc_feature: GZ8MTXP01B28FP.4.37.D04.1.454.CMB.2.raw
  modified_base (226)..(226): a, c, t, g, unknown or other
  modified_base (443)..(443): a, c, t, g, unknown or other
tcagagcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttctggatacaccttcaccgcctaactatatgcacgtgggtgcgactcggcccctggacagggcttggagtggatgggatggactcgacctaagaggcggtaggacaacgaaagtatgacacgagtaagtttcgagggcagggtcacagtcgacgagggacacgtcatcagcacggtcatcagcacacgcctaacngtcgacctggacgccgggcttcggaccagtcgacgacggcgaccgggtctagtaattctggcggaacgttgggaag

SEQ ID NO: 402085 - DNA, 568 bp, Homo sapiens
  misc_feature: GZ8MTXP01DNFJS.4.37.D04.1.454.CMB.2.raw
  modified_base (227)..(227): a, c, t, g, unknown or other
  modified_base (548)..(548): a, c, t, g, unknown or other
  modified_base (561)..(561): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctcctgcaaggcttcgtggatacaccttcacccgcctaactatatgcacgtgggtgccgtacgtcggcccccgtgggacgaaggggctttggagtggatggggatggactccggaacctaagaggcggtagggacaacgtaaaagtatggacaacgaggtaagtttcgagggcgaggggtcaccgatacgaaccgagggacacgtcatcagcacggtacatacagacacacgcctaacgcgtacggacctggacggccggtcgttaggacgttaacgtcgtcggaacgcgacgggtcctaagtttcgttcgnggttcggtaaggngggtaag

SEQ ID NO: 402086 - DNA, 522 bp, Homo sapiens
  misc_feature: GZ8MTXP01CTQ7H.4.37.D04.1.454.CMB.2.raw
  modified_base (227)..(227): a, c, t, g, unknown or other
  modified_base (249)..(249): a, c, t, g, unknown or other
  modified_base (368)..(368): a, c, t, g, unknown or other
  modified_base (508)..(508): a, c, t, g, unknown or other
  modified_base (513)..(513): a, c, t, g, unknown or other
  modified_base (517)..(517): a, c, t, g, unknown or other
  modified_base (519)..(519): a, c, t, g, unknown or other
  modified_base (521)..(521): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaggtctctgcaggcttcnggatacaccttcacccgcctactatatgcacgtgggtgccgacgtcggcccctggacgaaggggctttggagtggagtggggatggactccggacctagagcggtagacaacgaaagtntgacacgagtaagttcgagggcagggtcacgagtcgaacgagggacacgtcatcagcacggtcagtcacgcacgcgacctacacgtcgggacctggacggccgggcgttaggacgacggtcgacgacgacgcgtaacgtntgtgngcgngngng

SEQ ID NO: 402087 - DNA, 658 bp, Homo sapiens
  misc_feature: GZ8MTXP01AQAWK.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtggggtgcgactcggccccctggaccaagggcttggagtggatggggatggactccgaacctaagaggcggtaggacaacgaaagtatgacaacgaggtaaagtttcgagggacgaaggggtcaaccgagtacggaacccgaaggggaccaaccggtaccaataccgaacggaccaaccggggtaccaacgttaccaacggaccaacgacggacccttaaacgacgttaccgggaaccccgttgggaaccgggccggggacccgttacggggaaccaaacgggtcccgtacggttaaaccggttaccggaccggggtaacccgttaacgttaacttttcggggtacgggttacgggtaacgggaacggggtaaggg

SEQ ID NO: 402088 - DNA, 680 bp, Homo sapiens
  misc_feature: GZ8MTXP01CXZ3L.4.37.D04.1.454.CMB.2.raw
  modified_base (255)..(255): a, c, t, g, unknown or other
  modified_base (357)..(357): a, c, t, g, unknown or other
  modified_base (651)..(651): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaagccgtggggcctcagtgaaggtctcctgcaaggcttngatacaccttcaccgctactatatgcacgtgggtgcgacgtcgggcccctaggacgaagggtctttggaggttggagtggggatggactccggaacctaagnggcggtaaggacaacgaaaagtgtaggacaacgaaggtaacgtttacgaaggggcgtaacggggtacaaccgtaagtacgggaaaccgacggggaaccaccggtaccaacgtacgaacggaccctaacgggtccccgaataccgaacggacccaaaccgaccggtacccttaaacgacgttcgggggaaccccgttagggaacccggtcccggggtaccttacgggtaaccaacgggttccgaacggttaacccggttacgaccggggtaaccgttaattaaccgttttcgggngggttacgggtaacgggttaaggggtaag

SEQ ID NO: 402089 - DNA, 508 bp, Homo sapiens
  misc_feature: GZ8MTXP01A5O63.4.37.D04.1.454.CMB.2.raw
  modified_base (339)..(339): a, c, t, g, unknown or other
  modified_base (472)..(472): a, c, t, g, unknown or other
  modified_base (495)..(495): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
tcagagcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgctactatatgcacgtgggtgcgactcggcccctggacaagggcttggagtggatggatggactcgacctanagcggtgacaacaaagtatgacacagtaaagtttcagggcagggtcacgatgaccgagggacacgtacatcagcacggtcatcagccacacgcctaacgatcggacctggacggcgggccttggaccagtcgngacgcgacggcctataacttcgnggttgnggnggng

SEQ ID NO: 402090 - DNA, 522 bp, Homo sapiens
  misc_feature: GZ8MTXP01B9SLG.4.37.D04.1.454.CMB.2.raw
  modified_base (229)..(229): a, c, t, g, unknown or other
  modified_base (251)..(251): a, c, t, g, unknown or other
  modified_base (345)..(345): a, c, t, g, unknown or other
  modified_base (490)..(490): a, c, t, g, unknown or other
  modified_base (511)..(511): a, c, t, g, unknown or other
  modified_base (515)..(515): a, c, t, g, unknown or other
  modified_base (518)..(518): a, c, t, g, unknown or other
  modified_base (521)..(521): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctctgcaggcttntggatacaccttcaccgcctactatatgcacgtgggtgcgactcggcccctaggacaaggggcttggagtggatgggatggactcgacctaagngcggtagacaacgaaagtatcggacaacgtaggtaacgtttcgacggggacgaggggtcaccgagtacgaccgagggacacgtaccatcgagcacggtccagtcacgcacacgacctacatcggactgacgcggcttgacagtcncgacgcgacgcgtatcttcgngcgnggnggng

SEQ ID NO: 402091 - DNA, 573 bp, Homo sapiens
  misc_feature: GZ8MTXP01E2JVB.4.37.D04.1.454.CMB.2.raw
  modified_base (196)..(196): a, c, t, g, unknown or other
  modified_base (225)..(225): a, c, t, g, unknown or other
  modified_base (246)..(246): a, c, t, g, unknown or other
  modified_base (280)..(280): a, c, t, g, unknown or other
  modified_base (556)..(556): a, c, t, g, unknown or other
  modified_base (569)..(569): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgnggggctggaggtgaagagccgtgggcctnagtgaggtctctgcagcttcngataccacctcaccgctactatatgcacgtggtncgacgtcggcccctggacgaggtctggagtggagtggatggactacccgaccctagaggtcggtggaacaaacgaaggtatcgacgaacgtaggttaaacggttcgaggggaccgtagggtaccaaccgtagacggaccggaacggggaccaccgtacagtaccgacgaccaaccgtaccactaccgagaccaaccgcgtaccctaacgacgtcggacctggacggccgctaagccagttccgagaaccgacgcgttaccgttaatcgttaacggnggaggaggtcggngtgg

SEQ ID NO: 402092 - DNA, 567 bp, Homo sapiens
  misc_feature: GZ8MTXP01DD5YO.4.37.D04.1.454.CMB.2.raw
  modified_base (373)..(373): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggagcccactcccaggtgcagctggtgcagtcgtggggctggaggtgaagaagccgtggggcctcagtgaaggtctcctgcaaggtcttcgtggactacaccttcacccgcctactatatgcacgtgggtgcgactcgggcccctggacaagggtcttggaggtggatggggatggactccgacctaagagcgggtagacaacgaaagtntagacacgaagtagttcgaggtcagggtcacgagtgaccgaggacacgtcatcagcacggtcatcacgacacacgcctaacgacgtcggaccctggacgcgggtaccttaggaaccttagttaccgtacggaaccgttcgaccggggtccttaatttaacgtttcgtggttacggaacgggttaaggggtaagg

SEQ ID NO: 402093 - DNA, 550 bp, Homo sapiens
  misc_feature: GZ8MTXP01BEC6X.4.37.D04.1.454.CMB.2.raw
  modified_base (226)..(226): a, c, t, g, unknown or other
  modified_base (253)..(253): a, c, t, g, unknown or other
  modified_base (368)..(368): a, c, t, g, unknown or other
  modified_base (438)..(438): a, c, t, g, unknown or other
  modified_base (532)..(532): a, c, t, g, unknown or other
  modified_base (544)..(544): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtggggcctnagtgaaggtctcctgcgaaggcttcgnggatacaccttcaccgcctactatatgcacgtgggtcgcgactcggcccctggacaagggcttggagtggagtgggatggactccgaacctaagagcggtaggacaacgaaagtntagacaacgtaaggtagtttacgagggtcgagggtacacgagtcggaaccgacgggaaccacggtaccanaccgaagaccgacgggtaccataccaggccaacacgacctaacgagtcggacctggacggcgccagacagtccagacgttcgcggaaccttatnttcgtgttgtgnggaagg

SEQ ID NO: 402094 - DNA, 545 bp, Homo sapiens
  misc_feature: GZ8MTXP01EEOHW.4.37.D04.1.454.CMB.2.raw
  modified_base (227)..(227): a, c, t, g, unknown or other
  modified_base (351)..(351): a, c, t, g, unknown or other
  modified_base (469)..(469): a, c, t, g, unknown or other
  modified_base (523)..(523): a, c, t, g, unknown or other
  modified_base (532)..(532): a, c, t, g, unknown or other
  modified_base (537)..(537): a, c, t, g, unknown or other
  modified_base (540)..(540): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctctgcaaggcttctggatacaccttcaccgcctactatatgcacgtgggtgcgacgtcggcccctggacgaagggctttggaggtggagtggggatggactaccggacctaagngcggtaggacaacgaaagtatgacaacgagtaagtttcgagggcgagggtacacgagtacgaaccgagggacaccgtacacgtcgacgcaacggtcagtcagccacgacgacctaacncgtcggaccgtggacggccggcgttagacacgtcgagacgttacgcggtaactntaacgttgngttgnggnggaag

SEQ ID NO: 402095 - DNA, 682 bp, Homo sapiens
  misc_feature: GZ8MTXP01ATTHQ.4.37.D04.1.454.CMB.2.raw
  modified_base (394)..(394): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtgggcctcgagtgaaggtctcctgcaaggcttcgtgatacacctcaccgctactatatgctacgtgggtcgccgtacgtcgggccccctagggaacgtaaggggtcctttgggaggttgggagtggggaagtggactaccccgaccctaacgcggcgggtacggaacaaacgaaagtntacgacgtaaacgaaggtaacggtttacgaacggggacgtaggggtaccaccgtagtaccggaaaccgaacgggggaacctaccgggtacccaacgtaccacgaccgaccgttaccgactaccgaacgacccaaacgaccggacccttacgaacggtaccgggacccgttagggaaccggccggggtaacccgttgggaacccgtaacggttcccggaaccggaacggttaccggaccgggttaccctaagttacgttccggcggtcggacggtaacggaaggtaagg

SEQ ID NO: 402096 - DNA, 515 bp, Homo sapiens
  misc_feature: GZ8MTXP01AI74O.4.37.D04.1.454.CMB.2.raw
  modified_base (354)..(354): a, c, t, g, unknown or other
  modified_base (425)..(425): a, c, t, g, unknown or other
  modified_base (431)..(431): a, c, t, g, unknown or other
  modified_base (457)..(457): a, c, t, g, unknown or other
  modified_base (463)..(463): a, c, t, g, unknown or other
  modified_base (507)..(507): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacacctcaccgcctactatatgcacgtgggtgcgactcggcccctggacagggcttgagtggatgggatggatcccgacctagagcggtgacacaagtntgacacgagtaagttcgagggcgaggtcacgatgaccgaggacacgtccatcacgcacgtcatcagaccancgctanacgtcgcctggacgccggcctgaccngttcgnggacaccgcggttaccttaatacgttcgtgggtgcggtaagggngtaagggg

SEQ ID NO: 402097 - DNA, 628 bp, Homo sapiens
  misc_feature: GZ8MTXP01ARJS1.4.37.D04.1.454.CMB.2.raw
  modified_base (223)..(223): a, c, t, g, unknown or other
  modified_base (243)..(243): a, c, t, g, unknown or other
  modified_base (268)..(268): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggctnagtgaggtctctgcagctcnggatacaccttcaccgctactatangcacgtgggtgcgactcggcccctagggacaagggtcttggaggtggagtggggatcgggactaccggaccgtaagacggcgggtagggaccaacgaaaggtactggaccaagtaagggtaaacggtttacgaaggggtcgtacgggggtcaaccgagtacgaaccgaggggaccacggtaccatcagcacggtcatacacgcaacgtacgaccgttaacgacgttacgggaacccttagggccggtaaccgggccgttacgggaaccacggttaccgtcgggaaccgttaaccggaccgggtaaccggttacttaacggtttccgtaggggttcggtaacggggttaaggggtaagggg

SEQ ID NO: 402098 - DNA, 599 bp, Homo sapiens
  misc_feature: GZ8MTXP01BC9XP.4.37.D04.1.454.CMB.2.raw
  modified_base (225)..(225): a, c, t, g, unknown or other
  modified_base (339)..(339): a, c, t, g, unknown or other
  modified_base (598)..(598): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggctnagtgaggtctcctgcaaggctctggatacaccttcaccgcctactatatgcacgtgggtgcgactcggccccctggacaagggcttggagtggatgggatggactcgacctagngcggtgacaacgaaagtatgacacgagtaagtttccgagggtacaggggtacaaccgagtacgaacccgaggggaaccacggttaccaacgtcgaacgccgacggggtaccaataccgaagaccaaccgtaacgcccttaaccgaagttcgggaaaccccgtgggaacgggtccgggggtaaccgttcgggggacccgaaagggggacccgggtacccaaaacggttcgggacgaacgacgaacgacgacgacgcgcgng

SEQ ID NO: 402099 - DNA, 533 bp, Homo sapiens
  misc_feature: GZ8MTXP01AL4MN.4.37.D04.1.454.CMB.2.raw
  modified_base (354)..(354): a, c, t, g, unknown or other
  modified_base (375)..(375): a, c, t, g, unknown or other
  modified_base (518)..(518): a, c, t, g, unknown or other
  modified_base (526)..(526): a, c, t, g, unknown or other
  modified_base (529)..(529): a, c, t, g, unknown or other
  modified_base (532)..(532): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcgtgcaaggtcttctggactacacccttcaccgcctactatatgctacgtgggtcgcgacgtcggcccctggactagggctttggaggtggagtgggatggactccgacctaagnggcggtagaccaagaaagtangacacgagtattcgagggcagggtcacgatcgacgtagggacacgtcatcgacgtcaacggtccaatccgaacgccaccgagacccagtacgtcggacctcggacgcggccttagcagtcgacgacgcgacgtcgtatcttgngttacggnggnggng

SEQ ID NO: 402100 - DNA, 558 bp, Homo sapiens
  misc_feature: GZ8MTXP01EH8J0.4.37.D04.1.454.CMB.2.raw
  modified_base (226)..(226): a, c, t, g, unknown or other
  modified_base (235)..(235): a, c, t, g, unknown or other
  modified_base (251)..(251): a, c, t, g, unknown or other
  modified_base (371)..(371): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagcgtgggcctnagtgagtcnctgcagctgtgatacnctcaccgctatatatgcacgtgggtcgcgtacgtcggccccgtaggaccgtaagggtctttaggaggtggagtggggatggactaccgaaccgtaagcggcggtacgacaacgtaaagtntcggacacgtaagtagtttcgagggcgaggtcacgagtcgaaccgagggacacgtcagtcagccacggtcatcacgcacacgcctaacacgtcgaccgtcggcgtccggtcgacggaccttacgtacgtacgaaccggacgaccggtgttacttaagttcgtggttcggaagggttaagggtaaggg

SEQ ID NO: 402101 - DNA, 600 bp, Homo sapiens
  misc_feature: GZ8MTXP01CYWZG.4.37.D04.1.454.CMB.2.raw
  modified_base (382)..(382): a, c, t, g, unknown or other
  modified_base (496)..(496): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttcgtggatacaccttcaccgctactatatgcacgtgggtcgcgacgtccggccccgtaggacgaagggtctttggaggtggagtggggatggacctaccgaacctaagaggcggtagacaacgaaagtangacacgagtaagttcgagggcgagggtcaacgatcggaacgtagggactaccgtacatcgagccacggtaccagtccaacgccaacgacgacccttaacgacgttcggacccgnggacggccgggtaccttagggaccttacgttcgcggaaaccgttacggaccggttaacccgttaagttcgtttaccggtggttacgggtcgggaaggggtaagg

SEQ ID NO: 402102 - DNA, 502 bp, Homo sapiens
  misc_feature: GZ8MTXP01ATA0L.4.37.D04.1.454.CMB.2.raw
  modified_base (357)..(357): a, c, t, g, unknown or other
  modified_base (363)..(363): a, c, t, g, unknown or other
  modified_base (368)..(368): a, c, t, g, unknown or other
  modified_base (493)..(493): a, c, t, g, unknown or other
  modified_base (495)..(495): a, c, t, g, unknown or other
  modified_base (497)..(497): a, c, t, g, unknown or other
  modified_base (499)..(499): a, c, t, g, unknown or other
  modified_base (501)..(501): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggtcttcgtggatacaccttcaccgcctactatatgcacgtgggtgcgactcggcccctggacagggcttggagtggatgggatggactccgacctagaggcggtagcaanaaagtngacanaagaagtttcgagggcagggtcacgatcgacgaggacacgtcatcagcacggtcatcacgcaacacgcctacacgtcggacctgacggcggcttggaccagtcgagacgacgcggctagtcttgngngngngng

SEQ ID NO: 402103 - DNA, 569 bp, Homo sapiens
  misc_feature: GZ8MTXP01EFHBQ.4.37.D04.1.454.CMB.2.raw
  modified_base (226)..(226): a, c, t, g, unknown or other
  modified_base (546)..(546): a, c, t, g, unknown or other
tcagagcactgtagcacgaccggtgctcgatttagtagcatactgttgggtttgggggagcatcacccagcaaccacatctgtcctctagagaatcccctgagagcctccgttcctcaccatggactggacctggaggatcctcttcttggtggcagcagccacaggagcccactcccaggtgcagctggtgcagtcgtgggctgaggtgaagagccgtgggcctnagtgaggtctctgcaggcttcgtggatacaccttcaccgcctactatatgcacgtgggtgcgtacgtcggccccctagggacgaagggtctttaggaggtggagtggggatggactccgaacctaagacgcgggtaacgacaacgaaagtatcgacacgagtaggtttcgagggcgagggtacacgtagcggaaccgagggacacggtacccatcacgcacggtacatcacgacgacacacctacgacgtacgggacctggcggaacgcgttaggacagtcgacgaccgttacgccggtaaccgtattaacgttttcggnggttacggtaacggaagggtaag

SEQ ID NO: 402104 - DNA, 572 bp, Homo sapiens
  misc_feature: GZ8MTXP01BUUTL.4.37.D04.1.454.CMB.2.raw
  modified_base (387)..(387): a, c, t, g, unknown or other
  modified_base (561)..(561): a, c, t, g, unknown or other
  modified_base (563)..(563): a, c, t, g, unknown or other
  modified_base (565)..(565): a, c, t, g, unknown or other
  modified_base (567)..(567): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtagaagagccgtggggcctgagtgaggtctcctgcaggtcttcgtggactacaccttcaccgtcctaactatatgactacgtgggtcgccgacgtcggccccgtaggacgtaagggtctttggaggtggagtggggatggacctaccgacctaagaggcggtaagacaacgaaagttngacaacgtaaggtaacgtttcgaggggacgtagggtacacgagtacggaaccgagggacacggtacagtacgagaccacggtacatccgacgaccaacgacgacctaacgacgtacggaccctaggacggccgggacttgggacacgtacgacgacgcgacgtcgtatcttggngngngnggaag

SEQ ID NO: 402105 - DNA, 463 bp, Homo sapiens
  misc_feature: GZ8MTXP01C784H.4.37.D04.1.454.CMB.2.raw
  modified_base (251)..(251): a, c, t, g, unknown or other
  modified_base (333)..(333): a, c, t, g, unknown or other
  modified_base (338)..(338): a, c, t, g, unknown or other
  modified_base (341)..(341): a, c, t, g, unknown or other
  modified_base (348)..(348): a, c, t, g, unknown or other
  modified_base (405)..(405): a, c, t, g, unknown or other
  modified_base (411)..(411): a, c, t, g, unknown or other
  modified_base (424)..(424): a, c, t, g, unknown or other
  modified_base (426)..(426): a, c, t, g, unknown or other
  modified_base (431)..(431): a, c, t, g, unknown or other
  modified_base (438)..(438): a, c, t, g, unknown or other
  modified_base (456)..(456): a, c, t, g, unknown or other
  modified_base (458)..(458): a, c, t, g, unknown or other
  modified_base (460)..(460): a, c, t, g, unknown or other
  modified_base (462)..(462): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctggggcctcagtgaaggtctcctgcaaggcttcnggatacaccttcaccgcctactatatgcactgggtgcgactggcccctggacaagggcttgagtgatggatggatcgactanagcgngcncaaagtntgcacagaagttcaggcagggtcacgatgaccaggacacgtcatcagcacggtcatnagcacngctacatggaccngngcgcngacagcngacgcgcgctatctctgngngngng

SEQ ID NO: 402106 - DNA, 530 bp, Homo sapiens
  misc_feature: GZ8MTXP01EE22C.4.37.D04.1.454.CMB.2.raw
  modified_base (198)..(198): a, c, t, g, unknown or other
  modified_base (225)..(225): a, c, t, g, unknown or other
  modified_base (245)..(245): a, c, t, g, unknown or other
  modified_base (364)..(364): a, c, t, g, unknown or other
  modified_base (449)..(449): a, c, t, g, unknown or other
  modified_base (460)..(460): a, c, t, g, unknown or other
  modified_base (523)..(523): a, c, t, g, unknown or other
  modified_base (527)..(527): a, c, t, g, unknown or other
  modified_base (529)..(529): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgnggggctgaggtgaagagcgtgggcctnagtgaggtctctgcaggctnggatacacctcaccgctactatatgcagtgggtgcgacgtcggcccctaggacgaagggctttggaggtggagtgggatggactccggaacctaagaggcggtagacaacgtaaagtanggaccaagaggtagttacgaggcgagggtcacagtcgaaccgagggacacgtccatcgacgcacggtccaatccgacgaccaacncgtacctaacngtacggacctggacgggccggtcgacgggacaacgggtcaacgacgcgacggctatcgtgtgngcgngng

SEQ ID NO: 402107 - DNA, 678 bp, Homo sapiens
  misc_feature: GZ8MTXP01EVAC1.4.37.D04.1.454.CMB.2.raw
  modified_base (255)..(255): a, c, t, g, unknown or other
  modified_base (382)..(382): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctgagtgaaggtctcctgacaggcttcgnggactacaccttcaccgcctactatatgcacgtgggtcgccgtacgtccggccccgtaggacgagggtcttggaggtggagtgggagtggacctccggacctaagagcggtacggacaacgaaagtnacgacaagtaggtaacgtttcgagggtcgaacgggtcaccgtagtacgaaccggaggaccaccggtacactacgacgtacccgaccggggttccaacgtaccgacggacccaacgaccgtacccgttaacgacgtaccggtaaccgtcgggaaccgggtcccgggacccgttacggaacccggttaacgttacccgggtaaccggaaacccggttacggaacccgggttaacccggttaaagttaacccgttttacggggtacgggttacgggtaaccgggttaagggggtaacgg

SEQ ID NO: 402108 - DNA, 566 bp, Homo sapiens
  misc_feature: GZ8MTXP01AV6AD.4.37.D04.1.454.CMB.2.raw
  modified_base (255)..(255): a, c, t, g, unknown or other
  modified_base (484)..(484): a, c, t, g, unknown or other
  modified_base (546)..(546): a, c, t, g, unknown or other
  modified_base (560)..(560): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaggtcttcnggactacacccttcaccgtcctactatatgcacgtgggtgccgtacgtcggccccctggacgaaggggtcttggaggtggagtgggatggacctcgacctaagagcggtagacaacgaaagtatgacacgaggtaagttcgagggcgagggtacacgatcggaaccgagggacacgtcatcagccacggtccatccgagaccacgacgcctaacgacgtcggtacccgnggacggccgggtcttacgggacacgtcgacggttaccgcggacgccgttataacgtttcggnggttcggtaacggngggaag

SEQ ID NO: 402109 - DNA, 553 bp, Homo sapiens
  misc_feature: GZ8MTXP01EVQMF.4.37.D04.1.454.CMB.2.raw
  modified_base (225)..(225): a, c, t, g, unknown or other
  modified_base (244)..(244): a, c, t, g, unknown or other
  modified_base (249)..(249): a, c, t, g, unknown or other
  modified_base (262)..(262): a, c, t, g, unknown or other
  modified_base (332)..(332): a, c, t, g, unknown or other
  modified_base (354)..(354): a, c, t, g, unknown or other
  modified_base (404)..(404): a, c, t, g, unknown or other
  modified_base (425)..(425): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggcctnagtgagtctctgcaggctngatcnctcacgctatatntgcacgtgggcgcgacgtcggccctaggacgaggtcttggagtggagtgggatggactccgaacctaagnggcggtaagacaacgtaaagtntcgacaacgtagtacgttcgagggcgaggtacacgagtcgaacgaggacncgtcactacagccacggtcancagcacgacgtctaacgagtccggactacggagcccgggtcacggaacgttactacgaaccggacgaccggttaccgggtccttaatttccggtttcgggtacgggttacggtaacgggttaagggtg

SEQ ID NO: 402110 - DNA, 569 bp, Homo sapiens
  misc_feature: GZ8MTXP01ARD3K.4.37.D04.1.454.CMB.2.raw
  modified_base (225)..(225): a, c, t, g, unknown or other
  modified_base (247)..(247): a, c, t, g, unknown or other
  modified_base (374)..(374): a, c, t, g, unknown or other
  modified_base (559)..(569): a, c, t, g, unknown or other
tcagagcactgtagcacgaccggtgctcgatttagtagcatactgttgggtttgggggagcatcacccagcaaccacatctgtcctctagagaatcccctgagagcctccgttcctcaccatggactggacctggaggatcctcttcttggtggcagcagccacaggacgcccactcccaggtgcagctggtgcagtcgtgggctgaggtgaagagcgtgggctnagtgaagtctctgcagtcttcngatacacttcaccgctactatatgcacgtgggtgcgacgtcggccccgtaggaccgaaggggtctttggagtggtaagtggggatggaacctccggaacctaagaggcggtaaggacaacgaaagtntgacaacgtagtaacgggtttcgggacgtacggggtccacgtagacggaccgaacggggaccaaccggttaccacgttaccgaacgcccgaccgtacccataccgacgaccaacgacgtaccctaacgacggttcggaacccgtggaacggccggggctcgggaccgaaagggcgacagttacgnnnnnnnnnnn

SEQ ID NO: 402111 - DNA, 647 bp, Homo sapiens
  misc_feature: GZ8MTXP01B6AKK.4.37.D04.1.454.CMB.2.raw
  modified_base (254)..(254): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtggggctggaggtgaagagccgtggggcctgagtgaggtctctgcaggtcttcgnggatacaccttcaccgtctactatatcgctacggtgggtcgccgtacgtccggccccgtaggaacgaggggtctttaggaggtggagtgggagtggacctccgacctaagacggcggtaggacaacgtaaagtagtcgaccaagtaagggtaagtttcggagggcgtaacggggtacaaccgagtaacggaccggaacggggaacctaccggtaccactaccgaacgaccgtaaccgggtaccctaagtaccgaacgacctaaccgaccgtacccttaaacgacgttccgggaaccgtagggaaccggccgggccgttacggaacgacggtaccgacggttaacgttacggacgtaaccggtattcgttcgttgggacggtcggaaggtaagg

SEQ ID NO: 402112 - DNA, 592 bp, Homo sapiens
  misc_feature: GZ8MTXP01COT86.4.37.D04.1.454.CMB.2.raw
  modified_base (254)..(254): a, c, t, g, unknown or other
  modified_base (261)..(261): a, c, t, g, unknown or other
  modified_base (356)..(356): a, c, t, g, unknown or other
  modified_base (377)..(377): a, c, t, g, unknown or other
  modified_base (532)..(532): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctcgagtgaaggtctctgcaggtcttgngactacnccttcaccgctactatatgcagtgggtcgcgacgtcggcccctaggaacgagggtctttaggaggtggagtggggatggacctccggaacctagnggtcggtagacaacgaaagtnagcaacgagtaacgttcgagggtacgagggtaccacgagtacggaaccgtagggaccacggtaccacgtacgacgccgaacgggtcaacgtccacggaccaaccgacggtaccctacgacggtccgggaccctgggaccggcggtcccgaggacncgtacgcgaaccgcgacgggtaacttaattcgttcgaggttcgaacgggaaggtaacggg

SEQ ID NO: 402113 - DNA, 591 bp, Homo sapiens
  misc_feature: GZ8MTXP01BIO27.4.37.D04.1.454.CMB.2.raw
  modified_base (301)..(301): a, c, t, g, unknown or other
  modified_base (366)..(366): a, c, t, g, unknown or other
  modified_base (388)..(388): a, c, t, g, unknown or other
  modified_base (577)..(577): a, c, t, g, unknown or other
  modified_base (582)..(588): a, c, t, g, unknown or other
  modified_base (590)..(590): a, c, t, g, unknown or other
tcagagcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctcgagtgaacggtctcctgacgaaggtcttcgtggactaccaccttcaccgcctactatatgctacgtgggcncgacgtcggcccctagggacaagggtcttggacggtggagtggggatggactccgaaccgtaagnggcggtacggacaacgaaagtntgacacgagtacgtttcgagggcgacgggtcacgacgtacggaaccggacgggacaccggtacaacgtaccgaacgcccgtaaccggggtacctacgtaccaacgaccaaccgacgtcccgtaacgtacgtaccgggtaaccgtgggaaccggggcgggtcgagggaccgggaaacggccgagttacgnggcgnnnnnnngng

SEQ ID NO: 402114 - DNA, 583 bp, Homo sapiens
  misc_feature: GZ8MTXP01DMFX2.4.37.D04.1.454.CMB.2.raw
  modified_base (254)..(254): a, c, t, g, unknown or other
  modified_base (385)..(385): a, c, t, g, unknown or other
  modified_base (455)..(455): a, c, t, g, unknown or other
  modified_base (568)..(568): a, c, t, g, unknown or other
  modified_base (578)..(578): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccaggtgcagctggtgcagtcgtggggctggaggtgaagaagccgtggggcctgagtgaagtctctgcaggtcttcngatacaccttcaccgctactatatgcagtgggtgccgacgtcgggcccccgtaggaccgtaaggggtctttaggaggttggagtggggatggacctccgaacctaagacggtcggtaggacaacgaaagtntacgacaacgaggtaacgtttcgagggcgagggtccaacgagtacggaaccgacgggaccacggtaccancgacgcccacggtccataccacgaccaacgtacgacctacgacgtcggaccgtggacggccggtcgttacggaacttcgtacgacgaacgttcggacgtaagtacttcgtggngacggaaggngtaag

SEQ ID NO: 402115 - DNA, 576 bp, Homo sapiens
  misc_feature: GZ8MTXP01BXXCM.4.37.D04.1.454.CMB.2.raw
  modified_base (345)..(345): a, c, t, g, unknown or other
  modified_base (551)..(551): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcagtgaaggtctctgcaaggcttctggatacaccttcaccgtcctactatatgcacgtgggtgcgactcggcccctaggacgaagggcttggagtggatgggatggactcgacctaagnggcggtagacaacgaaagtagtagacaacgaagtaaaggtttccgaaggggtacgaacggggtacaaccgagtacggaacccgaaggggaccacggtaccactcagccacggtccatcacgaccacacgacctaacgagtcggacctggacgcggccttggacacgtccgtagaccgttacgaccggtaacgtattaacgtttcgnggttacggaacggttaagggtaagg

SEQ ID NO: 402116 - DNA, 590 bp, Homo sapiens
  misc_feature: GZ8MTXP01BD9D2.4.37.D04.1.454.CMB.2.raw
  modified_base (563)..(563): a, c, t, g, unknown or other
  modified_base (574)..(574): a, c, t, g, unknown or other
tcagagcactgtagcacgaccggtgctcgatttagtagcatactgttgggtttgggggagcatcacccagcaaccacatctgtactctagagaatcccctgagagctccgttcctcaccatggactggacctggaggatcctcttcttggtggcagcagccacaggacgcccactcccaggtgcagcgtggtgcagtcgtggggctggaggtgaagaagccgtggggcctgagtgaaggtctcgtgacaaggtcttcgtggataccaccttcaccgtctactatatgacacgtgggtgcgactcggccccgtaggacgaagggtcttggaggtggtagtggggatacggactaccgaaccgtaagaggcggtaaggacaacgaaagtctagacgaacgtaaggtaacgtttcggagggcgacgggtacacagtacgaacgagggacacgtcactcacgtacgacgtcacgtacgacgaccaaccgacgtaccctaacgacgtcggaccgtcggacggcccgggtacttggaaccagtcccgtagaaccggcgacggtaacgtnttaacttcggnggttacggtgaaggtg

SEQ ID NO: 402117 - DNA, 559 bp, Homo sapiens
  misc_feature: GZ8MTXP01CSFXP.4.37.D04.1.454.CMB.2.raw
  modified_base (363)..(363): a, c, t, g, unknown or other
  modified_base (428)..(428): a, c, t, g, unknown or other
  modified_base (543)..(543): a, c, t, g, unknown or other
tcagagcactgtagcacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctggggcctcagtgaaggtctcctgcaaggcttctggatacaccttcaccgctactatatgcactgggtgcgactggcccctggacaaggggctttgagtggatgggatggactcggacctaagagcggtaggcaacgaaaagtntagacaacgagtaaagtttcgaaggggccaggggtacacgactggaaccaggggactacgaccanacacgacacggtacaataccacgaccaaccgacgtacctaacagtaccgggaccgtaggacggccgggccgttagggacaacgtacgtacgacgacgacggaacgtataacgttntgttgtcggaaggaag

SEQ ID NO: 402118 - DNA, 555 bp, Homo sapiens
  misc_feature: GZ8MTXP01AI0MN.4.37.D04.1.454.CMB.2.raw
  modified_base (378)..(378): a, c, t, g, unknown or other
  modified_base (551)..(551): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctcctgcaagcttcgtggatacacctcaccgcctactatatgcacgtgggtgccgacgtcggccccgtaggacgaaggggtcttaggaggtggagtgggatggactccccgaacctagaggtcggtggaacaacgaagtntcgacacgagtaacgttcgacgggtacgagggtacacgagtacgacgaacgggacacgtaccagtcacgccacgtcatcgacgacacgacgacctagacgtcgaccgtgacggcggaacgtcgacgtacgccgacgacttacgcggttctaacttgtcgtgacgggcggtggnggtg

SEQ ID NO: 402119 - DNA, 503 bp, Homo sapiens
  misc_feature: GZ8MTXP01BWEA0.4.37.D04.1.454.CMB.2.raw
  modified_base (347)..(347): a, c, t, g, unknown or other
  modified_base (363)..(363): a, c, t, g, unknown or other
  modified_base (441)..(441): a, c, t, g, unknown or other
  modified_base (489)..(489): a, c, t, g, unknown or other
  modified_base (493)..(493): a, c, t, g, unknown or other
  modified_base (498)..(498): a, c, t, g, unknown or other
  modified_base (500)..(500): a, c, t, g, unknown or other
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctctgcaaggcttctggatacaccttcaccgcctactatatgcacgtgggtgcgacgtcggcccctggacaaggggctttggagtggagtgggatggactcgacctagngcggtgcaacaaagtngcacgagaagtttcgagggcgagggtcacgatggaacgagggacacgtcatcagccacggtcatcacgcacagcctancgtcgaccgtggagcggcgttggacgagcgtgacgttcgacggctatntcgngttgngngng

SEQ ID NO: 402120 - DNA, 648 bp, Homo sapiens
  misc_feature: GZ8MTXP01EH6D7.4.37.D04.1.454.CMB.2.raw
  modified_base (237)..(237): a, c, t, g, unknown or other
  modified_base (244)..(244): a, c, t, g, unknown or other
  modified_base (250)..(250): a, c, t, g, unknown or other
  modified_base (266)..(266): a, c, t, g, unknown or other
  modified_base (350)..(350): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtagaagagcgtgggctgagtgagtctcngcagctngatacncctcaccgctactatntcgcacgtgggcgcgacgtccggaccccgtaggacgaagggtcttaggagtggagtggagtcggtacctacccgaaacctaagnggtcggtagacaacgaaagtctagaccaaacgtaggtaacgttcggagggacgacgggtaccaacgtacgtacggaacccggaacgggacctaacccggtaccaacgtaccgacgtaccaccgggtaccaacgtaccgacgaccaacgaccgtaccctaacgtacgtaccggaccgtcggaacggcccggtaccgttacggaaccttacgttccgtaaccggaacccgacggttacccgggttaaccttagtttaaccgtttcggaggttacggggaacgggttaaggggttaacggg

SEQ ID NO: 402121 - DNA, 665 bp, Homo sapiens
  misc_feature: GZ8MTXP01A28LT.4.37.D04.1.454.CMB.2.raw
  modified_base (255)..(255): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgagtgaaggtctcctgcgaaggtcttntggactaccaccgttcaccgtcctactatatcgctacgtgggtcgcgtacgtcggccccgtggacgtagggctttagggagtggagtgggataggacctccggaacctaagaggtcggtaggacaacgaaagtagtcgactaacgaaggttaacggtttcgaacgggggcgaaacggggtccaaacgtagtaccggaaaccggacggggaacctaccggtacccaagaccgacgacccgtaccgggtaccaagtaccgaacgaccaaccgaccgtaccgtaacgtacgtaccgggaccgtcgggaccggtccggtccttacggaacgttacggtaccgaacgggaacccggttccgttaaccgggttaaccttagttaacgttcggtagggacgggtaacggaaggggtg

SEQ ID NO: 402122 - DNA, 649 bp, Homo sapiens
  misc_feature: GZ8MTXP01ADWQ5.4.37.D04.1.454.CMB.2.raw
  modified_base (230)..(230): a, c, t, g, unknown or other
  modified_base (253)..(253): a, c, t, g, unknown or other
  modified_base (358)..(358): a, c, t, g, unknown or other
  modified_base (379)..(379): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtcgtggggctggaggtgaagagccgtggggcctnagtgaggtctctgcaggcttcgnggactacaccttcaccgtcctactatatcgcacggtgggtgccgacgtcggcccctaggacaggggtcttggaggtggagtggggatggacctacggacctaagnggtcggtagacaacgaaagtncgacacgtagtaaagttcgagggcgaggggtaccacgtagacggaaccggacggggacaaccgtacctacgtaccgaacgaccgaccggggttcccaacgtaccaaccggaccaacccgtacggaaccccttacgaacggttccgggaaccccgtaggaccgggtccggtcccgttaggaccttaacgtaccgtacgggaacccgttacggaccggtaaccggtttaacttcgttcggtacggggttacgggtaacgggaacgggtaagg

SEQ ID NO: 402123 - DNA, 557 bp, Homo sapiens
  misc_feature: GZ8MTXP01EY71D.4.37.D04.1.454.CMB.2.raw
  modified_base (228)..(228): a, c, t, g, unknown or other
  modified_base (251)..(251): a, c, t, g, unknown or other
  modified_base (291)..(291): a, c, t, g, unknown or other
  modified_base (346)..(346): a, c, t, g, unknown or other
  modified_base (358)..(358): a, c, t, g, unknown or other
  modified_base (509)..(509): a, c, t, g, unknown or other
  modified_base (547)..(547): a, c, t, g, unknown or other
  modified_base (553)..(553): a, c, t, g, unknown or other
  modified_base (556)..(556): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtgggcctnagtgaaggtctctgcaggcttcnggactacaccttcaccgtacctactatatgcacgtgggtnccgacgtcggcccctaggacgaaggggtcttggaggtggagtggggatgggaccnccgaacctaagnggcggtaggacaacgaaagtatcggacaacgaggtagtttcgagggtacagggtacacgatacggaaccgagggaccacgtacacgtcgagccacggtcaatcacgacacgacgacctacgagtcggacgtcggacggcggtcgacggacncggacgtacgacgttacgacggtcgtataagtcgaggngtcggnggng

SEQ ID NO: 402124 - DNA, 566 bp, Homo sapiens
  misc_feature: GZ8MTXP01A9M8P.4.37.D04.1.454.CMB.2.raw
  modified_base (354)..(354): a, c, t, g, unknown or other
  modified_base (555)..(555): a, c, t, g, unknown or other
  modified_base (562)..(562): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggtcttcgtggataccaccttcacccgcctactatatcgcacgtgggtcgccgacgtcggcccccgtgggaacgaagggtctttggaggtggagtggggatggacnccgactagcggcggtaagacaagaaagtgcgacaagtaggtaagtttcggaggcgagggtacacgtagacgaaccggagggaccaccgtacacgtcaacgccacgggtaccagcgacgccaacgcgtaccaacacggtcgacccgtggacgggcccggtacgttacggacgaacgtcgacgacgcgacggcttattctcgngagtggnggtg

SEQ ID NO: 402125 - DNA, 553 bp, Homo sapiens
  misc_feature: GZ8MTXP01BIIKD.4.37.D04.1.454.CMB.2.raw
  modified_base (378)..(378): a, c, t, g, unknown or other
  modified_base (541)..(541): a, c, t, g, unknown or other
  modified_base (546)..(546): a, c, t, g, unknown or other
  modified_base (548)..(548): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcgagtgaaggtctcctgcaaggcttcgtggatacaccttcaccgcctactatatgcacgtgggtgcgacgtcggcccctgggacgaaggggtcttggaggtggagtggggatggactccgacctaagaggcgggtaggacaacgaaagtntacgacaacgtaggtaacggtttcgaggggtacgacggggtaccaccgtagtacggaaccggaacgggaccaccggtccatcgagccacggtccatcacgcaccacgacctacagtcggacctggacggccggcttggacagtcgcgacgcgcgcgtatcttngttgngnggaag

SEQ ID NO: 402126 - DNA, 510 bp, Homo sapiens
  misc_feature: GZ8MTXP01CO6YZ.4.37.D04.1.454.CMB.2.raw
  modified_base (245)..(245): a, c, t, g, unknown or other
  modified_base (251)..(251): a, c, t, g, unknown or other
  modified_base (352)..(352): a, c, t, g, unknown or other
  modified_base (440)..(440): a, c, t, g, unknown or other
  modified_base (465)..(465): a, c, t, g, unknown or other
  modified_base (471)..(471): a, c, t, g, unknown or other
  modified_base (505)..(505): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctggggcctcagtgaggtctctgcaggctngatacnctcaccgctactatatgcacgtgggtgccgactcggccccctggacaagggtcttggagtggatgggatggactcgacctagagcggtagacaacaaagtntgacacgagtaaagtttcgaggggtcagggtacacgagtcgaaccgagggactacgtccatcgagcacggtcatcagcacacgctacntcggacctggacgcggccttggacngtacgngacgttacgacggtcctataagttcagttgtcgnggaag

SEQ ID NO: 402127 - DNA, 632 bp, Homo sapiens
  misc_feature: GZ8MTXP01A1ZEP.4.37.D04.1.454.CMB.2.raw
  modified_base (249)..(249): a, c, t, g, unknown or other
  modified_base (336)..(336): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtagaagagcgtgggcctgagtgagtctctgcaggtctcgngatacaccttcaccgctactatatgcgacgtgggtcgcgacgtcggccccgaggacgagggtcttggaggtggagtgggatggaccncgacctaagcggcggtaacggacaacgaaagtagagactaacgaaggtacgtttcgacgggacgacgggtacacgagtacggaccggaggacaccgtacactacgacgaccgacggtacactccgaacggaccaaccgaaccgtacccgttaaacgacggtaccgggtaccgtacgggaccggaaccggtccgttacggaaccttacggtaccgtacggaaccggttaacgttacccgggtaacgtttaaccgttaagtttccggtaggttacggaacggggttaagggtaagggg

SEQ ID NO: 402128 - DNA, 614 bp, Homo sapiens
  misc_feature: GZ8MTXP01EN9SN.4.37.D04.1.454.CMB.2.raw
  modified_base (348)..(348): a, c, t, g, unknown or other
  modified_base (367)..(367): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctgagtgaggtctcctgcaggcttcgtggatacaccttcaccgtctaactatatgcacgtgggtcgcgacgtcggcccctaggacagggctttggagtggagtgggatggactccgacctaagngcggtagacaacgaaagtntggacaacgtaggtaacgtttcgacgggacgtaacgggtcaacgagtacggaaccgaacgggacaccgtaccactacacgaccaccgggtacaacgtccgaacgacaccgtacgacccttaacgacgtacgggtacccgtaggacggccgggccttacgggacttacggttccgtaacgacccgttaccgaaccgggtccgttaaagttcctttcgtacggggttacggtaacgggttaagggtaag

SEQ ID NO: 402129 - DNA, 513 bp, Homo sapiens
  misc_feature: GZ8MTXP01CC86Z.4.37.D04.1.454.CMB.2.raw
  modified_base (363)..(363): a, c, t, g, unknown or other
  modified_base (435)..(435): a, c, t, g, unknown or other
  modified_base (468)..(468): a, c, t, g, unknown or other
  modified_base (473)..(473): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccgcctactatatgcacgtgggtgcgactcggcccctggacaagggctttgagtggagtgggatggactccgacctaagaggcggtaggcaacgaaagtntgcacagtaagtttcgaggggcagggtcacgatcgaccgagggacacgtccatcagcacggtcatcagcacncgcctacagtcggacctggacgcggccttgacngtcgngacgcacggccttatctttcgngttcggcggaagggtaag

SEQ ID NO: 402130 - DNA, 604 bp, Homo sapiens
  misc_feature: GZ8MTXP01EHY6D.4.37.D04.1.454.CMB.2.raw
  modified_base (224)..(224): a, c, t, g, unknown or other
  modified_base (247)..(247): a, c, t, g, unknown or other
  modified_base (254)..(254): a, c, t, g, unknown or other
  modified_base (349)..(349): a, c, t, g, unknown or other
  modified_base (582)..(582): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcgtgggcctnagtgaaggtctctgcaggcttcnggatacnccttcaccgtctactatatgcacgtgggtgcgactcggcccctagggaccgaagggtctttggaggtggagtggggatggactccggacctaagnggcggtaggacaacgaaagtagtgaccgaacgaggtaaagttttccgaggggacgaaggggtccaaccgagtacggaacccgaggggaacctacggtccaacgcgacgaccgaccggtaccaacgtaccacgaccaacgacgtaccgtaacacgtacggacctacgggacggtccggtccgttacggacttacgtccgtaacggaccgacgacggtaacttattaacgttcgnggttacggaacggaagggtaag

SEQ ID NO: 402131 - DNA, 529 bp, Homo sapiens
  misc_feature: GZ8MTXP01B9W4F.4.37.D04.1.454.CMB.2.raw
  modified_base (224)..(224): a, c, t, g, unknown or other
  modified_base (466)..(466): a, c, t, g, unknown or other
  modified_base (510)..(510): a, c, t, g, unknown or other
  modified_base (516)..(516): a, c, t, g, unknown or other
  modified_base (525)..(525): a, c, t, g, unknown or other
  modified_base (528)..(528): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggctnagtgaggtctctgcaggcttctggatacaccttcaccgtcctactatatgcacgtgggtcgcgacgtcggcccctaggacgaagggtcttggagtggatgggatggactccggacctacgagcggtagacaagaaagtagtgacacgaggtaaaggtttcgagggtcgagggtccaaccgagtgaaccgagggaccacggtccagtcacgccacgggtccaagtccagccacgacgcctacntcggacctggcgcggcttggacagtctcgacgacgcggtctatntttcgngttcgcggnggng

SEQ ID NO: 402132 - DNA, 654 bp, Homo sapiens
  misc_feature: GZ8MTXP01EO3AW.4.37.D04.1.454.CMB.2.raw
  modified_base (226)..(226): a, c, t, g, unknown or other
  modified_base (246)..(246): a, c, t, g, unknown or other
  modified_base (253)..(253): a, c, t, g, unknown or other
  modified_base (401)..(401): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctnagtgaagtctctgcaggctntgatacncctcaccgctactatatcgctacgtggggtgccgacgttcgggccccctagggaaccgaagggggtcttagggtaaggtggggtagtgggggaattcgggaacctacccggaaacctaaagcggcggggtaacgacaacgtaaaagtnaggacgaagtaaggtaaacgtttcgaggggtagaacggggtcaagttagagaaccgaggggaccaacgtacacgacgagacccgtaacggtccaagtaccgacgaccgaaccacgtaccctaaaccgagttaccggggacccgtacgggacggtaacgggtccgttacgggacttacggtaccggtaacgaaccggttaccgttacggtaaccgttagttaacgttcgtaggttaggtaacggaagggtaagg

SEQ ID NO: 402133 - DNA, 518 bp, Homo sapiens
  misc_feature: GZ8MTXP01C3AVD.4.37.D04.1.454.CMB.2.raw
  modified_base (227)..(227): a, c, t, g, unknown or other
  modified_base (369)..(369): a, c, t, g, unknown or other
  modified_base (440)..(440): a, c, t, g, unknown or other
  modified_base (485)..(485): a, c, t, g, unknown or other
  modified_base (491)..(491): a, c, t, g, unknown or other
  modified_base (507)..(507): a, c, t, g, unknown or other
  modified_base (514)..(514): a, c, t, g, unknown or other
  modified_base (517)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaaggtctcctgcaaggcttctggatacaccttcaccgtcctaactatatgcacgtgggtgcgactcggcccctggacgagggctttggagtggagtggggatggactccgacctaagaggcggtagacaacgaaagtntgacacgagtaagttcgagggcgagggtcacgagtcgacgagggacacgtcatcgagcacggtcatcgacncaacacgctaacagtcggacctggacgcgggccttggacagtcgngaacgngacggctatcgttcgngttgcgnggng

SEQ ID NO: 402134 - DNA, 706 bp, Homo sapiens
  misc_feature: GZ8MTXP01AGK94.4.37.D04.1.454.CMB.2.raw
  modified_base (241)..(241): a, c, t, g, unknown or other
  modified_base (252)..(252): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggacgcccactcccaggtgcagctggtgcagtcgtggggctggaggtagaagagccgtgggcctgagtgaggtctccngcaggtcttgngactacacccttcaccgtactacgtatatgcctagtgggtcgcgtacgtccggcccctagggaacgtaggtcgttaggaggtacggagtaggggacgtagggtaccctacccggtaacccgtaagtcgggtacgggtaacgggaactaaccggtaaaagttcgtggaacccgtaagtaacgggtaacgtttacggacggggtaaccgacgggttaccaccgtagtacggaaccgagggtaccaccggtaccacacgtacgaccgtaccggtacgacgtccgacggtacctaaccgaccgtaccgtaaccgtacggtaccggtaccgttcggaaaccgggtccggtaccgttaggaaacccgttgttaccggaacggttaccgttaccggttaccggttaaccgttacgttaacgtttccggaagggtttccgggtaaggggaaaccgggtaagg

SEQ ID NO: 402135 - DNA, 630 bp, Homo sapiens
  misc_feature: GZ8MTXP01D1LYA.4.37.D04.1.454.CMB.2.raw
  modified_base (246)..(246): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtagaagagcgtgggcctgagtgaggtctctgcagtctngatacactcacgtctactatatgctacgtgggtcgcgacgtcggaccccgtagggaccgtaaggggtcttaggaggtggtagtgggggatcggtaacgtacccggaaaccgtaagaggtccgggtaaggacctaacgaaagttagtacggaccaaacggtaaggtaaacggttttacgaggggtacgacggggtacaaccgtagtacgaaccgacgggaacgtaccggacacgtacgacgaccgtaccggtaccgtaacgtacaacggaccaaccgacgtacctaacgacgtacggaccgtcggacgggccgcgttacggacacgtaccgtacggaacgcgttacgtcgttattaacgttcgtcggttcggtggaagggtaagg

SEQ ID NO: 402136 - DNA, 525 bp, Homo sapiens
  misc_feature: GZ8MTXP01AK338.4.37.D04.1.454.CMB.2.raw
  modified_base (227)..(227): a, c, t, g, unknown or other
  modified_base (352)..(352): a, c, t, g, unknown or other
  modified_base (370)..(370): a, c, t, g, unknown or other
  modified_base (518)..(518): a, c, t, g, unknown or other
  modified_base (522)..(522): a, c, t, g, unknown or other
  modified_base (524)..(524): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagcgtggggcctnagtgaaggtctctgcaggcttctggatacaccttcaccgcctactatatgcacgtgggtgcgactcggcccctaggacgaagggtctttaggaggtggtagtggggatggactcgaaccgtaagngcggtagcaacgaaagtngacacgagagttcgagggcagggtcaccgatcgacgagggacacgtcactcagccacggtccatccaagaccaacgacgacctaacgacgtacggaacctggacggcgggccgttaggacgacgtcgacgacgacgcgctatgtctgngtgngng

SEQ ID NO: 402137 - DNA, 500 bp, Homo sapiens
  misc_feature: GZ8MTXP01BR445.4.37.D04.1.454.CMB.2.raw
  modified_base (344)..(344): a, c, t, g, unknown or other
  modified_base (358)..(359): a, c, t, g, unknown or other
  modified_base (362)..(362): a, c, t, g, unknown or other
  modified_base (409)..(409): a, c, t, g, unknown or other
  modified_base (439)..(439): a, c, t, g, unknown or other
  modified_base (449)..(449): a, c, t, g, unknown or other
  modified_base (457)..(457): a, c, t, g, unknown or other
  modified_base (461)..(461): a, c, t, g, unknown or other
  modified_base (479)..(479): a, c, t, g, unknown or other
  modified_base (483)..(483): a, c, t, g, unknown or other
  modified_base (488)..(488): a, c, t, g, unknown or other
  modified_base (493)..(493): a, c, t, g, unknown or other
  modified_base (496)..(496): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagaagccgtggggcctcgagtgaaggtctcctgcaaggcttctggatacaccttcaccgcctactatatgcatgggtgcgactcggccccgtaggacgagggcttgagtggatgggatggactcgactagagngtagcaacaaagtnncanagagttcgaggcgagggtacacagtcgaaccgaggacctacgcaacncacgacacgtcactacacgacacacgacanacgtcgacgngcgcgcgngacncgtcgacgacgcgacgtntatnttcgngttgnggnggng

SEQ ID NO: 402138 - DNA, 580 bp, Homo sapiens
  misc_feature: GZ8MTXP01AO1JH.4.37.D04.1.454.CMB.2.raw
  modified_base (319)..(319): a, c, t, g, unknown or other
  modified_base (433)..(433): a, c, t, g, unknown or other
  modified_base (512)..(512): a, c, t, g, unknown or other
tcagagcactgtagcacgaccggtgctcgatttagtagcatactgttgggtttggggggaagaggaagactgacggtcctcccaggagttcaggtgctgggcaccgtgggcagtgggggaggcgtggtccagcctggggggtccctgagactctcctgtgcagcgtctggattcgccttcagtgcctatggcatgcacgtgggtccgccaggcctccgagggcgaagggggctgggaagtggggtggctagtttatagttggtttgataggaaactaacaaattctatgcagactccgtagaaggccgattcaccatcnccagagactaatttcgagaacacattgaaatctaacagatacgaacagtctagagaagccgaaggacacggctgtctagttatgtgacgagagtagtgtcagtgtctttgacgngtgggaccgaggaaccgtggacgtaccgtctcctcgcgtctaccgaccgtacggtccacgtccggtaacccttccccgnggtcccgcccgtcgcccttccgaggccgcccgtaccgtcggtcgggccgacgtaacggccggtcccgg

SEQ ID NO: 402139 - DNA, 620 bp, Homo sapiens
  misc_feature: GZ8MTXP01C9R0H.4.37.D04.1.454.CMB.2.raw
  modified_base (231)..(231): a, c, t, g, unknown or other
  modified_base (616)..(616): a, c, t, g, unknown or other
tcagagcactgtagcacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctnagtgaaggtctccgtgcaggcttcgtggatacaccttcacccgtcctaactatatgctacgtgggtgcgacgtccggcccctggaaccgaggggtctttaggacggttggagtggggatcgggactccgacctaagaggcggtaggacaacgaaagtgtagacaacgtaggtaaagtttcggaaggggcgaagggtaccacgaagtcggaaccgacggggacaccggtaccagtcgagtacccacgggtacccaagtaccacgacaaccgacgtaccctaaacgtcgtaccgggtacccgtagggaccgggaacccggggtcttacggaaccgacggtaccgacggaacgttacgacggtcctatcgttcggtggttacggcggnggtg

SEQ ID NO: 402140 - DNA, 600 bp, Homo sapiens
  misc_feature: GZ8MTXP01C6VKQ.4.37.D04.1.454.CMB.2.raw
  modified_base (591)..(591): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggagggtgaagaagccgtggggcctcgagtgaagtctcctgcaaggcttctggatacaccttcaccgcctactatatgctacgtgggtcgaccgacgtcgggcccccgtagggaaccgaagggggtctttaggaggtggagtggggatggactccgaacctacgaggcggtaagacaacgaaaagtatagacaacgaaggtaaacgtttcgaggggtacgacgggtaccacgagtacggaaccgaggggaccaacggtaccagtacacgacccgtaacgggtaccaactacgaacgacaaccacgaccctacacgtacgggacctgggacggccgggaccgttcgacgacgtcgcggacgcgacgtcgtattaagttcgtggttcgnggaagggtg

SEQ ID NO: 402141 - DNA, 561 bp, Homo sapiens
  misc_feature: GZ8MTXP01CVLOZ.4.37.D04.1.454.CMB.2.raw
  modified_base (254)..(254): a, c, t, g, unknown or other
  modified_base (352)..(352): a, c, t, g, unknown or other
  modified_base (372)..(372): a, c, t, g, unknown or other
tcagagcactgtagcacgaccggtgctcgatttagtagcatactgttgggtttgggggagcatcacccagcaaccatatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcagtgaaggtctcctgcaggcttgnggatacaccttcaccgcctactatatgctacgtgggtgccgacgtcggccccgtggacgagggtctttggagtggagtgggatggactccgacctagnggcggtagacaacgaaagtntcgacagagtaagttcgagggcgagggtacacgagtacggaccgacgggacacgtccatacacgaccacgggtcatccacgccacgacgcctacgacgtcggacctggacggccggccttagacacgttccgacggaccgaccgacgggtccttattaacgtttcgtggttaggccgggaagggtaagg

SEQ ID NO: 402142 - DNA, 514 bp, Homo sapiens
  misc_feature: GZ8MTXP01BARIU.4.37.D04.1.454.CMB.2.raw
  modified_base (226)..(226): a, c, t, g, unknown or other
  modified_base (365)..(365): a, c, t, g, unknown or other
  modified_base (506)..(506): a, c, t, g, unknown or other
  modified_base (510)..(510): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggacctnagtgaaggtctctgcaaggcttcgtggatacaccttcacccgcctactatatgcacgtgggtcgcgactcggcccctggacaagggcttggagtggatggggatggactccgacctaagaggcggtagacaagaaagtntgcacgagaaagtttcgagggcgagggtcacgagtcgaacgagggacacgtcatcagcacggtcatcacgcacgacgcctacagtcggacctggacggcggtccgttaggaccaggtcgcgacgcgcgtcgtatctgtggngcgnggng

SEQ ID NO: 402143 - DNA, 573 bp, Homo sapiens
  misc_feature: GZ8MTXP01EGCXX.4.37.D04.1.454.CMB.2.raw
  modified_base (238)..(238): a, c, t, g, unknown or other
  modified_base (250)..(250): a, c, t, g, unknown or other
  modified_base (256)..(256): a, c, t, g, unknown or other
  modified_base (381)..(381): a, c, t, g, unknown or other
  modified_base (543)..(543): a, c, t, g, unknown or other
  modified_base (552)..(552): a, c, t, g, unknown or other
  modified_base (559)..(559): a, c, t, g, unknown or other
  modified_base (566)..(566): a, c, t, g, unknown or other
  modified_base (569)..(569): a, c, t, g, unknown or other
  modified_base (572)..(572): a, c, t, g, unknown or other
tcagagcactgtagcacgaccggtgctcgatttagtagcatactgttgggtttgggggagcatcacccagcaaccacatctgtcctctagagaatcccctgagagcctccgttcctcaccatggactggacctggagatcctcttcttggtggcagcagccacaggacgcccactcccaggtgcagctggtgcgagtcgtggggctgaggtagaagagccgtgggctgagtgacgtcnctgcagtcttcngatacncctcaccgtctatatatgctacgtggtcgccgacgtccggccccgtaggacgtagggtcttagaggtggacgttgggagtggaacccttaccgaacctaagcgacggtggaactaacgaaagtcngaaccagtaacggtagtttcgagggcgtacggtacaacgatacgaccggtaggaccactacgactacgacgaccgaccgtcaacgtccgaacgaccgtaacacggtacccaagtcgtacggtaccgacggcggcgcgttaggaccttagcgtagacgttacncggtaactngttacgngttacgnggnggng

SEQ ID NO: 402144 - DNA, 594 bp, Homo sapiens
  misc_feature: GZ8MTXP01AE7L8.4.37.D04.1.454.CMB.2.raw
  modified_base (224)..(224): a, c, t, g, unknown or other
  modified_base (233)..(233): a, c, t, g, unknown or other
  modified_base (245)..(245): a, c, t, g, unknown or other
  modified_base (581)..(581): a, c, t, g, unknown or other
  modified_base (584)..(584): a, c, t, g, unknown or other
  modified_base (593)..(593): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggctnagtgagtcnctgcagtctcgngatacacctcaccgctactatatgcacgtgggtcgcgacgtcggcccctaggacgaaggtcttaggaggtggagtgggatggactaccgacctaagcggcggtaggacaacgaaagtactcgacaacgaaggtacgtttacgaggggtacaacggggtaccaacgtaagtacgaaaccggaacggggaacctaaccggtaccacgtaccgaacgtacccgaaccggttacccgaactaccgaaccggaccaaccgacgaccttaacgacgttcggacccgtaggacggtccgggcttaggacaacgtcgacgacgacgacggtaactatcgttcgnggngcggaaggng

SEQ ID NO: 402145 - DNA, 529 bp, Homo sapiens
  misc_feature: GZ8MTXP01AGA7S.4.37.D04.1.454.CMB.2.raw
  modified_base (229)..(229): a, c, t, g, unknown or other
  modified_base (250)..(250): a, c, t, g, unknown or other
  modified_base (353)..(353): a, c, t, g, unknown or other
  modified_base (370)..(370): a, c, t, g, unknown or other
  modified_base (374)..(374): a, c, t, g, unknown or other
  modified_base (516)..(516): a, c, t, g, unknown or other
  modified_base (518)..(518): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctnagtgaggtctctgcaggcttngatacaccttcaccgctactatatgcacgtgggtcgccgacgtcgggcccctagggaccgaagggggtctttggaggtggagtggggatggactcgacctagngcggtagcaagaaagtngcanagtaagtttcgagggcagggtacaccgagtcgacgagggacacgtaccatcacgcacggtcatcacgccacacgacctacacgtcggacctggacggccggccttggacgacgtacgacgacgcgaccgtcgtataattcgngngtggnggtaag

SEQ ID NO: 402146 - DNA, 649 bp, Homo sapiens
  misc_feature: GZ8MTXP01BJ97S.4.37.D04.1.454.CMB.2.raw
  modified_base (361)..(361): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcgagtgaaggtctcctgcaaggcttcgtggatacaccttcaccgtcctactatatgctacgtgggtcgcgactggccagtcggacgaagggtcttggaggttggagtggggatacggatacgacccgtaacgnggacgggtggcaaacaaagtatggacaacgagtaagtttacgaggggacgacggggtacaacgaacgtacggaaccggaacggggtaccgaaccgggtacccaacgtaccgaacggaccggaaccggttaccaacgtacgaaccggaccaacccgaacggacccctaacgtacggttacgggaacccgtcgggaaccgggtccgggaccgtacggaccgaaacggtcgacggaccggttacgaaccgggtaccgtaattacgttacgttcggtaaggcggtaaggggg

SEQ ID NO: 402147 - DNA, 686 bp, Homo sapiens
  misc_feature: GZ8MTXP01DH29F.4.37.D04.1.454.CMB.2.raw
  modified_base (253)..(253): a, c, t, g, unknown or other
  modified_base (355)..(355): a, c, t, g, unknown or other
  modified_base (376)..(376): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtggggctgagtgaggtctccgtgacaggcttcgnggactacaccttccacccgcctactatatgcacgtgggtgccgacgtcggcccctggaccgaagggtcttggaggtggagtgggagcggactccgactaagnggcggtaggaccaagaaagtntagacaacgaggtaacgttcggagggacgagggtaccaaccgagtacggaaccgacggggaaccaccggtacccttaagaccgaacggaccctacccggggttaccaacttacccgacggtacccaaaccacggtacccttaaacgaacggtccgggacccgtacgggaaccggcccggggtcccttacgggaaccaacgtttaccccgaacgggttaaaccccgaccgggttaacccggggttaaccttaaacgttttaaccggttttaccggtggggttaccggaacgggggttaaggggtaacgggg

SEQ ID NO: 402148 - DNA, 645 bp, Homo sapiens
  misc_feature: GZ8MTXP01BCOYC.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgagtcgtggggctggaggtagaagagccgtgggcctgagtgaggtctctgacaggtcttcgtggactacaccttcaccgtcctaactatactgcacggtgggtcgaccgtacgtcggccccgtagggaccgaagggtcttggaggtgggtagtggggagttggacctaccgaaccgtaagacgggtcggtaacggacaacgaaaggtatcggacaagtaggtaacgtttacggacgggcgacgggtacacgagtacggaacccgagggacaccggtaccagtaccgacgaccgaaccggtccagtacccgaacgaccaaccgacgtaccctaaccgacgtccgggaccgtcgggaccgaaccgggtcttacgggaccgagtaccggtaacggaaccgaccggacggttccgttaattccgttggttcggcgggtaacggttaaggggaaggg

SEQ ID NO: 402149 - DNA, 525 bp, Homo sapiens
  misc_feature: GZ8MTXP01A8R0A.4.37.D04.1.454.CMB.2.raw
  modified_base (249)..(249): a, c, t, g, unknown or other
  modified_base (256)..(256): a, c, t, g, unknown or other
  modified_base (457)..(457): a, c, t, g, unknown or other
  modified_base (498)..(498): a, c, t, g, unknown or other
  modified_base (514)..(514): a, c, t, g, unknown or other
  modified_base (521)..(521): a, c, t, g, unknown or other
  modified_base (524)..(524): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctgagtgaggtctctgcagcttcnggatacncttcacccgtcctactatatcgctacgtgggtgcgacgtcggcccctggacgaaggggctttggagtggatgggagtggtactcccgacctaacgacggcggtaggaccaacgaaagtatacgactacgagtaagttcgagggtcagggtcacatgaccagggacacgtcatacagcacggcagtcacgccagcgacctancgtcggaacctggacggccggtcttggacttgacgcgacgnacggcctagtaactgngagcggnggng

SEQ ID NO: 402150 - DNA, 696 bp, Homo sapiens
  misc_feature: GZ8MTXP01DHODS.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgacaaggtcttctggatacaccttcaccgcctactatatgcacgtgggtgccgacgtcggccccgtggacgaaggggtctttaggaggttggagtggggatgggaccttaccggacctaagacggcggtaacggacaacgaaagtactaggaccaacgtaagggtaagggtttcgggggactaggggtaccaacccgagtacggaacccgaaggggaacctaccggtacccaagtaccgacggacctaaccggttaccacgttaccgaaacgaccgaaaccgaacggtacccctaaacgtaacggttaccggggtaacccttacggggaaccggtccggggaacccgttagggaaacccgtacggttaccgttaacgggaacgttaaccggaacgggttcccggttaataacgtttcgtcgggtacgggacggaaggggttaaggtaagggg

SEQ ID NO: 402151 - DNA, 688 bp, Homo sapiens
  misc_feature: GZ8MTXP01EQX16.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggacgcccactcccaggtgcagctggtgcagtcgtggggctgaggtagaagaagccgtggggcctgagtgagtctctgcaaggtctctggatacaccttcaccgtacttacgtactactcgtacgtacggtcggtcgaccggtaccgtccggaccccgtacggaaccggtgaacccggttacggtagtaggggtaggtagggtaaagggtacgggtaacgtaacggtaacccgtaaccccgtaaacgacggtacgggtaacgggtacgtaaacgtaaacgtaagtacgaacgtaacgaaaggtaacgttaacgggtacggacggaacggtacgaaccgtaacgacgaaccggggaacggaacgtaaccgtaaccgtacctacgtaccgacgtacccgtaccgtactacgacgaccaaccgaaccgttaccgtaaccgttaacggtaccggtaccggttaccggttcgggaccggtaaccggtaccgtaacggaacgtacggttacggtaacgttaacggtaaccg

SEQ ID NO: 402152 - DNA, 546 bp, Homo sapiens
  misc_feature: GZ8MTXP01BEHDM.4.37.D04.1.454.CMB.2.raw
  modified_base (225)..(225): a, c, t, g, unknown or other
  modified_base (246)..(246): a, c, t, g, unknown or other
  modified_base (284)..(284): a, c, t, g, unknown or other
  modified_base (347)..(347): a, c, t, g, unknown or other
  modified_base (368)..(368): a, c, t, g, unknown or other
  modified_base (427)..(427): a, c, t, g, unknown or other
  modified_base (456)..(456): a, c, t, g, unknown or other
  modified_base (466)..(466): a, c, t, g, unknown or other
  modified_base (526)..(526): a, c, t, g, unknown or other
  modified_base (529)..(529): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcgtggggcctnagtgagtctctgcaggcttcnggatacaccttcaccgtcctaatatatgcacgtgggtncgacgtcggcccctggaccgagggtctttggagtggatggggatcggactccggaacctaagngtcggtaggacaacgaaagtntgacctaagagtaagttcgagggcagggtcacgagtacgaaccgagggacacgtaccancagcctacggcatcagcaacgcacctacncgtcggaccngacggcggccttaggacacgtcgacggacgttcgaccggtaaccgttattaacgtttcgnggnggtaacgaaggggaacg

SEQ ID NO: 402153 - DNA, 571 bp, Homo sapiens
  misc_feature: GZ8MTXP01A648Q.4.37.D04.1.454.CMB.2.raw
  modified_base (223)..(223): a, c, t, g, unknown or other
  modified_base (241)..(241): a, c, t, g, unknown or other
  modified_base (247)..(247): a, c, t, g, unknown or other
  modified_base (260)..(260): a, c, t, g, unknown or other
  modified_base (355)..(355): a, c, t, g, unknown or other
  modified_base (426)..(426): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtgggcctnagtgagtctctgcagctngatacnctcaccgctactntatgcacgtggtgcgacgtcggcccctaggacgagggcttggagtggagtgggatggactcccgaccctaagacggcggtagaaccaacgaagtntagacaacgaaggtaacggtttcgaggggacgagggtaccacgagtacggaacgacgggactacgacctanccagaccacgtccatcgaacacctaacgacgtccgaactacgtacgtacccgtaggacggtccggcctggaccgtaacgttccgacgtaaccgacgttccgggttacctaattacgttcgtggcggacggaagggttggtaaggg

SEQ ID NO: 402154 - DNA, 613 bp, Homo sapiens
  misc_feature: GZ8MTXP01BVQ53.4.37.D04.1.454.CMB.2.raw
  modified_base (229)..(229): a, c, t, g, unknown or other
  modified_base (255)..(255): a, c, t, g, unknown or other
  modified_base (356)..(356): a, c, t, g, unknown or other
  modified_base (426)..(426): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaggtcttcgnggataccaccttcacccgtcctaactatatgctacgtgggtcgcgacgtcggcccctggacgagggtcttggagtggagtgggatggactccgacctaagnggcggtagacaacgaaagtgtcgacaacgagtacgttcgagggcgagggtcacgagtacgacgagggacncgtcagtcgagcgacggtacacgtcacgccaacgacgtaccgtaacgagtccggtaaccgtcgggaaccggccgggtaccgttaggaacccgttaacggttccgtaacgggaacccggttaacggttacccgggtaacttacgttaaccgttttcggaggttacgggaaccgggttaaggggtaagg

SEQ ID NO: 402155 - DNA, 648 bp, Homo sapiens
  misc_feature: GZ8MTXP01A6R4V.4.37.D04.1.454.CMB.2.raw
  modified_base (258)..(258): a, c, t, g, unknown or other
  modified_base (364)..(364): a, c, t, g, unknown or other
  modified_base (629)..(629): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctctgacaaggtcttcgnggataccaccttcaccgtactactatatcgctacgtgggtcgcgacgtcggcccctagggacaagggtcttaggaggtgagtgggatcggactaccggacctaagnggcggtaagacaacgtaaagtagtcgacgtaacgtaagggtaaacgtttcggaacggggtcgtaacggggtaccaaaccgtacgtacggaaacccggaacggggaaccctacccgtaacccgagtaaccgacggtaccctacggggtaccaactaccgacgaccaacgcgtaccctaacgtagtaccggaccttagggacggccgtcgttacgacgttacgtaccgaacgaccgttcacccgggtaactagttaactttcggagnggtaacggaagggtaacgg

SEQ ID NO: 402156 - DNA, 544 bp, Homo sapiens
  misc_feature: GZ8MTXP01CEPD2.4.37.D04.1.454.CMB.2.raw
  modified_base (253)..(253): a, c, t, g, unknown or other
  modified_base (354)..(354): a, c, t, g, unknown or other
  modified_base (367)..(367): a, c, t, g, unknown or other
  modified_base (373)..(373): a, c, t, g, unknown or other
  modified_base (482)..(482): a, c, t, g, unknown or other
  modified_base (487)..(487): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctccgtgcaggcttcnggactacaccttcaccgcctactatatgctacgtgggtgcgtacgtcggcccctaggaccgaagggtctttggagtggatgggatggactccgacctaagnggcggtagacaanaaagtngacacgagtagttcgagggcagggtcacgagtcgacgagggacacgtccatcagccacggtacagtccacgacacgacgactacacgtgacctggacgcgccttggacngtcgnggaccgacgacgggtaaccttaagttcgtttacgtgggagtaacgggaagggtaagg

SEQ ID NO: 402157 - DNA, 656 bp, Homo sapiens
  misc_feature: GZ8MTXP01B63Z7.4.37.D04.1.454.CMB.2.raw
  modified_base (370)..(370): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagaagccgtggggcctcagtgaggtctcctgcaaggcttcgtggatacaccttcaccgcctaactatatgcacgtgggtgcgactcggccccctggacgaagggcttggagtggatggggatggactccggacctaagaggcggtaggcaacgaaagtntgacacgtaaggtaagtttcgaggggcacggggtcaaccgtagtacgaaccggaacggggaacaccggtaccaactcgaacgccctaacggggtacccacgtaccgaacgaccaaccgaaccgtacccgttaaaccgacgttaaccgggacccgttacgggaaccgggcccggggtccgttacgggaacccgttaacgtaccccggtaacggaaccccggttaacggttacccggtaacccggttatttaacgtttccgagggttcgggcggttaaggggtaaggg

SEQ ID NO: 402158 - DNA, 525 bp, Homo sapiens
  misc_feature: GZ8MTXP01AL45K.4.37.D04.1.454.CMB.2.raw
  modified_base (227)..(227): a, c, t, g, unknown or other
  modified_base (247)..(247): a, c, t, g, unknown or other
  modified_base (364)..(364): a, c, t, g, unknown or other
  modified_base (449)..(449): a, c, t, g, unknown or other
  modified_base (513)..(513): a, c, t, g, unknown or other
  modified_base (519)..(519): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtgggcctnagtgaggtctctgcaggctngatacactcaccgctactatatgcacgtgggtcgccgactcgggcccctaggaccgaaggggtctttggagtggagtgggatggactccggacctaagcgcggtagcaacgaaagtngacaacgagtaaagtttcgagggcgacgggtacaccgagtacgaaccgaggacacgtaccatcgagccacggtcatcgacgcacncgacctacacgtcggacctggacgcggcttggacagtcgacgacgcgacgtcctataacttggngttcgngaagtg

SEQ ID NO: 402159 - DNA, 550 bp, Homo sapiens
  misc_feature: GZ8MTXP01AIDYX.4.37.D04.1.454.CMB.2.raw
  modified_base (228)..(228): a, c, t, g, unknown or other
  modified_base (540)..(540): a, c, t, g, unknown or other
  modified_base (543)..(543): a, c, t, g, unknown or other
  modified_base (545)..(545): a, c, t, g, unknown or other
  modified_base (547)..(547): a, c, t, g, unknown or other
  modified_base (549)..(549): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctctgcaggcttctggatacaccttcaccgctactatatgcacgtgggtgcgactcggacccctagggacgaaggggctttggaggtggagtggggatgggactccgacctaagaggcggtaaggacaacaaagggtactgacaacgtagtaaagtttcgaggggcgacggggtacaccgagtagaaccgagggacaccggtccatcgacgccaacgggtccatcacgccacgacgacctacgagtcggacctggcggaacggcgttggaccgaaggtcgacgttacgcgacgaacgtgtgtntgngngngng

SEQ ID NO: 402160 - DNA, 541 bp, Homo sapiens
  misc_feature: GZ8MTXP01AB1OL.4.37.D04.1.454.CMB.2.raw
  modified_base (143)..(143): a, c, t, g, unknown or other
  modified_base (361)..(361): a, c, t, g, unknown or other
  modified_base (464)..(464): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctnttcttggtggcagcagccacaggagcccactcccaggtgcagctggtgcagtctgggggctggaggtgaagaagccgtgggggcctcgagtgaaggtctcctgcaaggcttctggatacaccttcaccgcctactatatgcactgggtgcgactcggcccctggacagggcttggagtggatgggatggactcgactagagcggtagacaacaaagtntagcaacgaggtaagtttcgagggcagggtcaccgagtacgacagggacacgtcatcagcacgggtcaatcgaacgcaacacgtacctacgacgtacggaccncggacggccggtcacggacacgtacgacgaaccgacgacggtccgtattaatttccggngttcggaacgaaggtaag

SEQ ID NO: 402161 - DNA, 636 bp, Homo sapiens
  misc_feature: GZ8MTXP01ETOXM.4.37.D04.1.454.CMB.2.raw
  modified_base (226)..(226): a, c, t, g, unknown or other
  modified_base (247)..(247): a, c, t, g, unknown or other
  modified_base (622)..(622): a, c, t, g, unknown or other
  modified_base (632)..(632): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctnagtgagtctcctgcaggcttngatacactcaccgtctactatatcgctacgtgggtcgccgtacgtcgggcccccgtagggaccgtaaagggggtctttaggacggtggtagtagggggattggggaacctacccggtaaacccgtaagacggtccggggtaacgacaacgtaaaaggttgacgaccgtaacgtaaggtaaagggtttcccgaggggtacgtacggggtacaaccgagtaccggaaccgacggggaacctacgtaccacgtacgaacgtacccgtaaccggggtaccataccgacggaccaaccacgacttaaccgcgttacggaccgtaggacggcgggtaccttgaccgagtccgacgacgttcgacggtcgtataacgttcgngttacgtggnggtg

SEQ ID NO: 402162 - DNA, 537 bp, Homo sapiens
  misc_feature: GZ8MTXP01AXHQU.4.37.D04.1.454.CMB.2.raw
  modified_base (338)..(338): a, c, t, g, unknown or other
  modified_base (354)..(354): a, c, t, g, unknown or other
  modified_base (404)..(404): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccgcctactatatgcacgtgggtgcgactggcccctggacaagggcttgagtggatggatggactcgacctanagcgtgcaacaaagtntgcacgagaagtttcgaggcagggtcaccatgaccagggacacgtaccanacacgacacggtacactacacgacacgacgacctacgacgtacggaccgtcggacggccgggtaccgttggacgacgtacgtacgaccggacgacggaacgtacgttaacgttcgtgttagtcggaaggaagg

SEQ ID NO: 402163 - DNA, 541 bp, Homo sapiens
  misc_feature: GZ8MTXP01BKV9E.4.37.D04.1.454.CMB.2.raw
  modified_base (229)..(229): a, c, t, g, unknown or other
  modified_base (372)..(372): a, c, t, g, unknown or other
  modified_base (530)..(530): a, c, t, g, unknown or other
  modified_base (532)..(532): a, c, t, g, unknown or other
  modified_base (537)..(537): a, c, t, g, unknown or other
  modified_base (540)..(540): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctnagtgaggtctctgcaggcttcgtggatacaccttcaccgtcctactatatgcacgtgggtgccgacgtcggcccctaggaccgaggggtctttggagtggagtggggatggactccgacctagagcggtagacaacgaaagtngacacgagtagttcgagggcgagggtacacgagtacgaccgagggacacgtccactcgacgccacggtccagtccacgaccaccgacgtcctaacgacgtcggacctggacggccgggcgttcggacacgtccgacgacgcgacgtcgtatcgttcgngngtcgnggng

SEQ ID NO: 402164 - DNA, 522 bp, Homo sapiens
  misc_feature: GZ8MTXP01E05T6.4.37.D04.1.454.CMB.2.raw
  modified_base (225)..(225): a, c, t, g, unknown or other
  modified_base (246)..(246): a, c, t, g, unknown or other
  modified_base (340)..(340): a, c, t, g, unknown or other
  modified_base (360)..(360): a, c, t, g, unknown or other
  modified_base (506)..(506): a, c, t, g, unknown or other
  modified_base (508)..(508): a, c, t, g, unknown or other
  modified_base (515)..(515): a, c, t, g, unknown or other
  modified_base (517)..(517): a, c, t, g, unknown or other
  modified_base (519)..(519): a, c, t, g, unknown or other
  modified_base (521)..(521): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaggtctctgcaggctcngatacaccttcaccgcctactatatgcacgtgggtgcgacgtcggcccctggacgaagggctttggagtggatgggatggactccgacctaagngcggtagacaacgtaaagtntgacacgaagtagtttcgagggacgaggggtcaaccgagtacgaaccgaggggaccacggtaccagtacagcacggtcatcacgacacgacgcctacgacgtcggacctggaggccgggcttggacacggcgacgacgttcacgtntntgtgtgngngngng

SEQ ID NO: 402165 - DNA, 512 bp, Homo sapiens
  misc_feature: GZ8MTXP01CYK7M.4.37.D04.1.454.CMB.2.raw
  modified_base (475)..(475): a, c, t, g, unknown or other
  modified_base (491)..(491): a, c, t, g, unknown or other
  modified_base (496)..(496): a, c, t, g, unknown or other
  modified_base (503)..(503): a, c, t, g, unknown or other
  modified_base (505)..(505): a, c, t, g, unknown or other
  modified_base (507)..(507): a, c, t, g, unknown or other
  modified_base (509)..(509): a, c, t, g, unknown or other
  modified_base (511)..(511): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttcgtggataccaccttcaccgcctactatatgcacgtgggtgcgacgtcggcccctggacgagggtcttggaggtggagtgggatggactccgacctaagaggcggtaggacaacgtaaagtagtgacaacgaggtaagttcgagggacgagggtacacgagtacgacgagggacacgtccagtcagcacggcatcagcacacgcctacagtcgactgacgcgcngacgagcgtcgacgcncgctntgttcgngngngngng

SEQ ID NO: 402166 - DNA, 542 bp, Homo sapiens
  misc_feature: GZ8MTXP01D59WU.4.37.D04.1.454.CMB.2.raw
  modified_base (286)..(286): a, c, t, g, unknown or other
  modified_base (357)..(357): a, c, t, g, unknown or other
  modified_base (438)..(438): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaaggtctcctgcaaggcttctggatacacctcaccgcctactatatgcactgggncgactcggcccctggacagggctgagtggagtgggatggactaccgacctagagcggtggacaacgaagtntcgacaacagtaagttcgagggcagggtcacgagtcgacgaggacacgcagtcagcacgtcgatcgacgtcatacgcctanacgtcggaccctggcgccgggctaggacctagttccgtacggaaccgacgacccgggttacttaagttacgtttcgtcggagaccgggaaggggaagtaacggg

SEQ ID NO: 402167 - DNA, 621 bp, Homo sapiens
  misc_feature: GZ8MTXP01BF32G.4.37.D04.1.454.CMB.2.raw
  modified_base (249)..(249): a, c, t, g, unknown or other
  modified_base (353)..(353): a, c, t, g, unknown or other
  modified_base (375)..(375): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctgagtgaaggtctctgcagcttgnggatacacctcaccgcctactatatgctacgtgggtcgcgaccgtcggcccccgtaggaacgaagggtcttaggaggtggagtggatggactccccgacctagnggcggtacggaacaacgaagtntgacagagtagttcgagggcgaggtacacgagtacgaccgacgggaccacggtaccacgtcgacgaccgtacccgtacaacgttaccgaacgaccaaaccgaccgtacccgtaacgaacggttccgggaacccgttagggaaccggtcccgggtaaccgtacgacgtacgttccgtacggaaccgaccggaccggttaccgttaagttacgttcgtcgggtggacgggaaggggttaaggtaaggg

SEQ ID NO: 402168 - DNA, 547 bp, Homo sapiens
  misc_feature: GZ8MTXP01BZSJJ.4.37.D04.1.454.CMB.2.raw
  modified_base (225)..(225): a, c, t, g, unknown or other
  modified_base (252)..(252): a, c, t, g, unknown or other
  modified_base (269)..(269): a, c, t, g, unknown or other
  modified_base (281)..(281): a, c, t, g, unknown or other
  modified_base (354)..(354): a, c, t, g, unknown or other
  modified_base (377)..(377): a, c, t, g, unknown or other
  modified_base (506)..(506): a, c, t, g, unknown or other
  modified_base (530)..(530): a, c, t, g, unknown or other
  modified_base (540)..(540): a, c, t, g, unknown or other
  modified_base (542)..(542): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggcctnagtgagtctctgcagtctgtggatacnctcacccgtctatatangcacgtgggtcncgtacgtcggccccgtaggacgaaggggtctttaggaggtggagtgggactaggacgtacccggacctaacgnggtcggtaagaccaagtaaagtntgactaacgaggtaacgttcgagggcgtacgggtacacgagtcggaaccgagggactaccgtcatcgagaccacggtacagtcacgccacgacgtccaagcgtccgacctggacggcggtcgttagacncgtcgacacgttacgcgtaacgtntcgtgagcgngngaagg

SEQ ID NO: 402169 - DNA, 654 bp, Homo sapiens
  misc_feature: GZ8MTXP01DFL42.4.37.D04.1.454.CMB.2.raw
  modified_base (224)..(224): a, c, t, g, unknown or other
  modified_base (235)..(235): a, c, t, g, unknown or other
  modified_base (281)..(281): a, c, t, g, unknown or other
  modified_base (375)..(375): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggctnagtgagtctcngcaggtctctgatacaccttcaccgctactatatgcacgtgggtcnccgtacgtcgggcccccttgggaaccgaggggtctttggaggtggagtggggatcgggactaccggaacctagcggcggtaggacaagaaagtntaggaccaagaggtacgttcgaggggcagggtacacgtagtacgaaccgacgggactaccggtacagtccaacgcccgtaacgggtacccaagtaccgacgaccaaacccgagaccccttaaacgacgttccgggaacccttgggaaaccgggcccgggttacccgttaggaaacccgttcgtacccggttaaggaccccggttaaacggttacccggggtaaccctttaaggttaacttttccgggtggttacgggaacgggttaagggggtaacggg

SEQ ID NO: 402170 - DNA, 683 bp, Homo sapiens
  misc_feature: GZ8MTXP01AO3BN.4.37.D04.1.454.CMB.2.raw
  modified_base (226)..(226): a, c, t, g, unknown or other
  modified_base (386)..(386): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtggggcctnagtgaggtctctgcaggtcttcgtggatacaccttcaccgtcctactatatgctacgtggggtcgcggacgtcgggccccctagggaccgtaagggggtcttaggaggtggagtggggatgggactccggacctaagcggcggtagggacaacgaaagtntagacaacgtaaggtaaacgtttcggacgggtacgacggggtaccaacgacgtacgggaacccgaggggaacctaccggtacccacgtaccgaacggtaccgaaccgggttaccctaacgtacccgaacgtacccgaaaccgacccgggtacccttaaacgtaaccgtaccgggtaacccgttacgggaacggccccggtacgttacggaaccttacgtcgtaaccggaaccggaccgttaccggtaaccgtttaagttaacgttttcggaggttaccggcgggttaagggtaaggg

SEQ ID NO: 402171 - DNA, 579 bp, Homo sapiens
  misc_feature: GZ8MTXP01CJGQD.4.37.D04.1.454.CMB.2.raw
  modified_base (265)..(265): a, c, t, g, unknown or other
  modified_base (525)..(525): a, c, t, g, unknown or other
  modified_base (532)..(532): a, c, t, g, unknown or other
  modified_base (563)..(563): a, c, t, g, unknown or other
  modified_base (571)..(571): a, c, t, g, unknown or other
  modified_base (574)..(574): a, c, t, g, unknown or other
  modified_base (578)..(578): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgaggtcgtggggctggagggtggaaagaagccgtggggcctcgagtggaaggtctccgtgcgaaggtcttcnggactacacccttcacccgtcctaactatatgcacgtgggtcgccggtacgtcggcccccgtggaccgtaaggggtctttggagtggagtgggagtggacctccgaacctagagcgggtagacaagaaagtatcgacagaagtaagttcgaggggcaggggtcacgatacggaccgagggaccacgtccagtcagccacggtccaagtccgagccaacgacgcctaacgctacgggaccctggacggccggtcgttgacngtaccgngaccggttagccggtaacgtattcgttcggnggttacgnggngggng

SEQ ID NO: 402172 - DNA, 561 bp, Homo sapiens
  misc_feature: GZ8MTXP01B0UOT.4.37.D04.1.454.CMB.2.raw
  modified_base (226)..(226): a, c, t, g, unknown or other
  modified_base (244)..(244): a, c, t, g, unknown or other
  modified_base (356)..(356): a, c, t, g, unknown or other
  modified_base (541)..(541): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagcgtgggctnagtgagtctctgcagctngatacacctcaccgctactatatgcagtgggtgccgacgtcggcccctaggacgagggcttggagtggagtgggatggactccgacctagcggcggtagacaacgaaagtangacacgagtacgttcgagggacgacgggtacacgagtacgaccgagggacacgtacagtcgacgaccacggtaccagtaccgacgaccaaccgacgacctaacgacgtcggaccgtcggcggaaccggtccgttgaccagtaccgacgttaccgacgttaccggtaaccttagttaacgttcggnggttacggtcgggaagggtg

SEQ ID NO: 402173 - DNA, 542 bp, Homo sapiens
  misc_feature: GZ8MTXP01ASXHM.4.37.D04.1.454.CMB.2.raw
  modified_base (250)..(250): a, c, t, g, unknown or other
  modified_base (258)..(258): a, c, t, g, unknown or other
  modified_base (346)..(346): a, c, t, g, unknown or other
  modified_base (363)..(363): a, c, t, g, unknown or other
  modified_base (526)..(526): a, c, t, g, unknown or other
  modified_base (532)..(532): a, c, t, g, unknown or other
  modified_base (536)..(536): a, c, t, g, unknown or other
  modified_base (539)..(539): a, c, t, g, unknown or other
  modified_base (541)..(541): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcagtgaggtctcctgcaggcttcnggataccnccttcaccgcctactatatgcacgtgggtgcgacgtcggcccctgggacaagggtctttggagtggagtgggatggactccgactagngcggtagcaacaaagtntgacaacgagtaaggttcgaggggcaagggtcaaccgaagtcggaacccgaggggtacaccggtaccatacgacgaccaccggtacactcgaacgccacgacgccctaacacgtcggaacccttggaacgccggtcaggtaccagtcagacgcgcggtaactntcgtgngcgnggngng

SEQ ID NO: 402174 - DNA, 616 bp, Homo sapiens
  misc_feature: GZ8MTXP01B4NH7.4.37.D04.1.454.CMB.2.raw
  modified_base (231)..(231): a, c, t, g, unknown or other
  modified_base (550)..(550): a, c, t, g, unknown or other
  modified_base (592)..(592): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccgaggtgcagctggtgcagtcgtggggctggaggtgaagaagccgtgggcctnagtgagtctctgcaggtcttcgtggactaccacccttcacccgtcctaactatatcgctacgtgggtcgccgtacgtccggcccccgtggaaccgtaaggggtctttaggaggtggagtggggatgggacctccggaaccgtagaggtcggtaacggacaacgaaagtgtacgactaacgtagggtaagtttcgaagggcgagggtaccacgagtacggaacccgagggaccacgtccagtccgagcccacgtacccagtaccacgccacgaccgtcctaacgaggtccgaacgttcggacggcccggtcgttgaccgngttccgacgaccgttccgaccgggtcttaagttcgtttcggnggttgggtaacggaagggtaaggg

SEQ ID NO: 402175 - DNA, 582 bp, Homo sapiens
  misc_feature: GZ8MTXP01ACC4D.4.37.D04.1.454.CMB.2.raw
  modified_base (260)..(260): a, c, t, g, unknown or other
  modified_base (387)..(387): a, c, t, g, unknown or other
  modified_base (409)..(409): a, c, t, g, unknown or other
  modified_base (511)..(511): a, c, t, g, unknown or other
  modified_base (536)..(536): a, c, t, g, unknown or other
  modified_base (554)..(554): a, c, t, g, unknown or other
  modified_base (565)..(565): a, c, t, g, unknown or other
  modified_base (572)..(572): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaacgccgtggggcctgagtgaaggtctcctgacgaaggcttcgnggataccgaccttcacccgtcctatatatcgctacgtgggtcgaccgacgttcgggcccctagggaaccgtaaggggtctttaggaacggtgggaagtggggatacggaccttaccggaccgtaagnggcggtagacaacgtaaaggtntcgacacgtaggtaacgttcgagggtcgagggtcaacgagtacgaccgagggaccacgtaccataccgagccgacgtacatccgaacgccacgcgacctacncgtcgaccgtggacgcgcttggacncgtcgtcgacgcgacgtntagttcgttgngttacgnggaaggtaag

SEQ ID NO: 402176 - DNA, 587 bp, Homo sapiens
  misc_feature: GZ8MTXP01EM2K4.4.37.D04.1.454.CMB.2.raw
  modified_base (247)..(247): a, c, t, g, unknown or other
  modified_base (459)..(459): a, c, t, g, unknown or other
  modified_base (483)..(483): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacttggaggatcctcttcttggtggcagcagccacaggagcccactcccaggtgcagctggtgcagtcgtgggctgaggtgaagagccgtggggcctcagtgaggtctctgcaaggctntggatacaccttcaccgctaactatatcgctacgtgggtcgcgacgtcggccccctagggaccgtaaggggtctttaggaggtggagtggggatcggaacctccggacctaagaggtcggtagggacaacgtaaagtctacggacaacgtaggtaaacgtttcgacggggtcgacggggtacaccgagtcggaaccgagggaccacgtccancagccacggtcataccagacaccncgtacctaacgcgtacggaccgtagaaccgggcggtacccgttggacccttagtaccgtagacgccgacgggtcctagtttcgttcgtggcggcggaaggtaag

SEQ ID NO: 402177 - DNA, 652 bp, Homo sapiens
  misc_feature: GZ8MTXP01BK2F0.4.37.D04.1.454.CMB.2.raw
  modified_base (226)..(226): a, c, t, g, unknown or other
  modified_base (236)..(236): a, c, t, g, unknown or other
  modified_base (247)..(247): a, c, t, g, unknown or other
  modified_base (254)..(254): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtgggctnagtgaggtcnctgcaggcttnggatacncttcaccgctatatatgcacgtgggtcgcgacgtcggcccctggacagggtcttggagtggagtgggatggacctaccgacctaagaggccggtagggacaacgaaagtgtacgaccaacgtaaggtaacgtttcggaggggtacgacggggtaccaaccgtagtacggaaacccggaggggtaaccctaccggtacccgtaacgaccgaacgtacccgtaaccggggttacccaacgttaccgaaccggaccaacccgaacggtacccttaaaccgtacggttaccgggacccgttcggggaacgtccgggggaccttacggaaccgttagtacccggtcgaaccggacgttaccgggtccttaattccgtttgcggttacggtcggaaggggtaag

SEQ ID NO: 402178 - DNA, 658 bp, Homo sapiens
  misc_feature: GZ8MTXP01A563L.4.37.D04.1.454.CMB.2.raw
  modified_base (259)..(259): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggggctggagggtagaaggaagccgtgggggcctcgagtgaaggtctcctgcaggcttcngatacaccttcacccgtctaactatatcgctacgtgggtcgccgtacgtcgggccccgtaggacgaaggggtctttggaaggtggagtggggatcgggactaccgaaccgtaagacggtcggtaagggacctaacgtaaagtatcggactaacgaaggtaacggtttcggagggtacgacggggtacaccgaatacggaaccgaacgggacctacggtaccacgtacgaacgccgtaccggtacccgtaacgtccgaacggaccaaccgtaacgaccctaaacgtaaccgtacgggtaccgtacgggaaccggccggtcccgttaggaaccttacggttcgtaacgaccggttacgaccgggtaacttactaagtttcgaggttgcgggttaaggaagg

SEQ ID NO: 402179 - DNA, 669 bp, Homo sapiens
  misc_feature: GZ8MTXP01B4PYG.4.37.D04.1.454.CMB.2.raw
  modified_base (243)..(243): a, c, t, g, unknown or other
  modified_base (255)..(255): a, c, t, g, unknown or other
  modified_base (281)..(281): a, c, t, g, unknown or other
  modified_base (650)..(650): a, c, t, g, unknown or other
  modified_base (663)..(663): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggacgcccacctcccgaggtgcagctggtgcgagtcgtggggctggaggtgaagagccgtgggcctgagtgaggtctccngcaggtcttcgnggactacaccttcaccgtcctaactntactcgctacgtgggtgccgtacgtccggcccccgtagggacgaagggtcgtttaggaggtggagtggggatacgggacctacccgaaaccgtaagacgggtcggtaacgaaccaagtaaaagtgtacggaaccaaggtagggttaaagtttccggaaggggtaccgaacggggtaccaacgacgtacggaaacccgacggggaacctaccggtaccagtaccgaacgacccgtaaccgtccctaagtccgaacgacccaaccgaccgtaccctaaaccgtacgtacccgggtaacgtcgggaaccggccgggtaccttacggaccgaacgtccgacgacggacgaccgggtaacctagttcgttcggnggttacggtcggnggtaag

SEQ ID NO: 402180 - DNA, 648 bp, Homo sapiens
  misc_feature: GZ8MTXP01CDBVK.4.37.D04.1.454.CMB.2.raw
  modified_base (250)..(250): a, c, t, g, unknown or other
  modified_base (277)..(277): a, c, t, g, unknown or other
  modified_base (286)..(286): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagagccgtgggcctgagtgagtctctgcaggtcttnggactacaccttcaccgtctactatangcagtgggncgacgtcggcccctggacgagggtcttggagtggagtggggatggacctccgaccgtaagaggtcggtaaggacaacgtaaagtagacgtacaacgtaaggtacgttacgaggggtacgtacgggtacaaccgtagtacggaaccgtacggggacaccgggtaccacgtacgacgtcccgtaaccgggtacctaagtaccgacgacctaaccgaccggtacccttaacaggtaccggacccgttagggaccggtaaccggtcgttacgtacgttacgttaccgtacggaaccgaccggttacccggttaaccgttagtttaacgtttccgtcgggttagggaacgggttaaggggtaagggg

SEQ ID NO: 402181 - DNA, 548 bp, Homo sapiens
  misc_feature: GZ8MTXP01BHMFR.4.37.D04.1.454.CMB.2.raw
  modified_base (227)..(227): a, c, t, g, unknown or other
  modified_base (237)..(237): a, c, t, g, unknown or other
  modified_base (248)..(248): a, c, t, g, unknown or other
  modified_base (378)..(378): a, c, t, g, unknown or other
  modified_base (509)..(509): a, c, t, g, unknown or other
  modified_base (537)..(537): a, c, t, g, unknown or other
  modified_base (544)..(544): a, c, t, g, unknown or other
  modified_base (547)..(547): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggcctnagtgaggtcnctgcaggctcngatacacttcaccgctactatatgcacgtggggtgccgtactcgggccccctaggaaccgaaggggctttaggaggtggagtggggatgggactccgaacctaagacggtcgggtaaggacaacaaagtntgacaacgaagtaacgtttcgacggggacgacgggtacaccgagtacggaaccgaaggggacacggtccaatcaagccacggtcatcacgcacgtcgactacagtcggaccgtcgaaggccggcttggacncgtcgcgacgcgacggctatccgttagngagtcgnggng

SEQ ID NO: 402182 - DNA, 650 bp, Homo sapiens
  misc_feature: GZ8MTXP01DKQC0.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggctgagtgaaggtctcctgcaaggtcttcgtggatacaccttcaccgcctaactatatgcacgtgggtcgtcgacgtcggcccccgtaggaccgtaaggggtctttaggaggtggagtggggatggactccggaacctaagacggcggtaggaccaagaaaagtagtcgacaacgaggtaacgtttcgaggggacgtaaggggtaccaaccgagtacggaacccgaggggaaccaaccggtacccagtaccgaagacccgaccgggttaccaagtccgaaacgaccaaccgacgtacccttaacgacggtaccggacccgttacgggacggcccggggtccacggaaccgacgtaccgtaacgaacggttaccgaccgggtccttaaatttccgtttcgacggttcggtaacggaacgggtaagggg

SEQ ID NO: 402183 - DNA, 536 bp, Homo sapiens
  misc_feature: GZ8MTXP01BPSSC.4.37.D04.1.454.CMB.2.raw
  modified_base (229)..(229): a, c, t, g, unknown or other
  modified_base (354)..(354): a, c, t, g, unknown or other
  modified_base (372)..(372): a, c, t, g, unknown or other
  modified_base (425)..(425): a, c, t, g, unknown or other
  modified_base (438)..(438): a, c, t, g, unknown or other
  modified_base (531)..(531): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaaggcttctggactacaccttcaccgcctaactatatgcacgtgggtcgcgacgtcggcccctaggaccaaggggctttggaggtggagtggatggactcgacctaagngcggtaggcaagaaagtntgcacagtaagtttcgagggcagggtcacgatacgacgagggacacgtaccancgagacacgtcancacgaccacgacgtacctaacgacgtacggaccgtcggacggcggtacttaggacacgtcgacgacgcgacgtctagtcgttcgtgcgtcggnggaag

SEQ ID NO: 402184 - DNA, 541 bp, Homo sapiens
  misc_feature: GZ8MTXP01AOS6T.4.37.D04.1.454.CMB.2.raw
  modified_base (373)..(373): a, c, t, g, unknown or other
  modified_base (473)..(473): a, c, t, g, unknown or other
  modified_base (528)..(528): a, c, t, g, unknown or other
  modified_base (530)..(530): a, c, t, g, unknown or other
  modified_base (537)..(537): a, c, t, g, unknown or other
  modified_base (540)..(540): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaggtcttcgtggatacaccttcaccgcctactatatgctacgtggggtcgcgactcgggcccctgggacaaggggcttggaggtggatggggatgggactccgacctaagagcggtagcaacgaaagtntgaccaacgaggtaagtttcgagggcacggggtcaccgagtacgaaccgagggacaaccgtccagtcagcacgggtcaacgtcacgcacgacgcctacgngtacggacctggaacgcgggacttgggaccagtcgtacgacgttcgacgctagtntntgcgtgnggng

SEQ ID NO: 402185 - DNA, 580 bp, Homo sapiens
  misc_feature: GZ8MTXP01AZUYL.4.37.D04.1.454.CMB.2.raw
  modified_base (251)..(251): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtggggcctgagtgaggtctctgcgaggtcttcgngatacacttcaccgctactatatgcagtgggtcgcgacgtcggcccctaggacgaagggtcttggaggtggagtggggatgggacctccggaacctaagacggtcgggtagacaacgaaagtagtcgaccaacgaggtaaacgtttcgagggcgagggtcacagtcgaacgagggtaccacgtacagcgagccacggtacagtaccgacgaccaacgacgaccgtaacgacgtcggaccgtggaccggcggtccgttcggacttacgtcgtaacgaccgttacgacggtccttagttaacgtttcgtggttacgcgggttaagggaagg

SEQ ID NO: 402186 - DNA, 599 bp, Homo sapiens
  misc_feature: GZ8MTXP01E0AJS.4.37.D04.1.454.CMB.2.raw
  modified_base (407)..(407): a, c, t, g, unknown or other
  modified_base (500)..(500): a, c, t, g, unknown or other
  modified_base (520)..(520): a, c, t, g, unknown or other
  modified_base (579)..(579): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtcgtggggctggaggtgaaggagccgtggggcctcgagtggaaggtctccgtgcgaaggcttcgtggtactactaccctcacccgccttactatatcgcacgttgggtcgccgtacgtccggccccgtaggaacgtaaggggtcttgggaggtgggagtgggggatacggacttacccgaaccccgtagacggcggtcgaaacaacgtaagtntacgacgaactagggtaagtttcgaggtcgagggtacacgagtcggaaccgaggaccgacgtccagtccgagcacgtacatcgagacacgacnccgtacgacgtcggtaccgngacggccggcgtgaaccgtcgttacgacgacggacgttcggacccgttaatagtttcgnggtgaggtaaggaaggtaag

SEQ ID NO: 402187 - DNA, 686 bp, Homo sapiens
  misc_feature: GZ8MTXP01EY5BG.4.37.D04.1.454.CMB.2.raw
  modified_base (667)..(667): a, c, t, g, unknown or other
  modified_base (678)..(678): a, c, t, g, unknown or other
tcagagcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtgggctgagtgaggtctcgtgacaaggtcttcgtaggactaccaccttcacccgtcctaactatacgtcgactacggtggggtcgaccgtacggtccggtaccccgtaggaacgaaggggtctttaggaaggtggacgtgggagtggaaccgtccgaaccgtaagcggccggtaagactaacgtaaagtgtagaccaaacgtaagggtaacgtttacggaacggggtacgtacggggtaccaaaccgtaagtaccggaaacccggaacgggggtaaccctaccgggttaacctaaacgtaccgaaaccgggtaccctaaccggggtaccctaaacgtaccgaacggtaacccaagaacccggtacctaaacgtacggtaccggaccgtacggaacggccgtcgttagaccttagtcgacgaaccgacgacgtcgttataacgtttgngttacggaagngggtaagg

SEQ ID NO: 402188 - DNA, 650 bp, Homo sapiens
  misc_feature: GZ8MTXP01DL2P8.4.37.D04.1.454.CMB.2.raw
  modified_base (257)..(257): a, c, t, g, unknown or other
tcagagcactgtagcacgaccggtgctcgatttagtagcatactggttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtcgtggggctggaggtagaagaagccgtggggcctcgagtgaggtctctgcaggtcttcgngatacaccttcaccgcctatatatcgcacgtgggtcgcgacgtcggcccctaggacgaagggtctttaggaggtggagtggggatggacctccggaacctacgagggcggtaacgggacaacgaaagtagtacgacgaacgaaggttaacggttcgaggggtcgtaaggggtcaaccgagtacggaaccgaggggaccaccggtacacgtcgacgccacgggtacccaataccaacggaccaaccgacgtaccctaaacgtacggttaccgggaacccgttagggaccggtcccgggcccgttagaaccgttacgtaccgtacgggaacccgttacggaccggtccgttaacgtttcgtttccggaggttcggaacgggttaaggggtaaggg

SEQ ID NO: 402189 - DNA, 703 bp, Homo sapiens
  misc_feature: GZ8MTXP01B8TNJ.4.37.D04.1.454.CMB.2.raw
  modified_base (201)..(201): a, c, t, g, unknown or other
  modified_base (256)..(256): a, c, t, g, unknown or other
  modified_base (693)..(693): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcgagtcgngggctggaggtgaagagccgtgggcctcgagtgaacggtctcgtgcagtcttcgngactacaccttcaccgtctaactatacgtcgactacgtgggtcgccgtacgtccggccccgtaggaaccgtaaggggtctttaggaggtaggagtggggatcggacctacccggaaaccgtaacgcggggtcggtaacggaacctaaggaaagttacgacgacaaacgtacgggtaacgtttaccgggaggacgtacgggtccaacgacgtacggaaccggacggggacctaccggaccactcgaacgtcccgtacgggtacccaacgtaccgaacgacccgaacgtacccgtacccttaacgacggtaccggtaacccgtacgggcccgggtccgggtaccttacggggaaacccttacggttacccgtaaccggaacccggttaccggacccggttaaccgttagttaacgttcggtcgggttaggtaacggggngggtaacggg

SEQ ID NO: 402190 - DNA, 658 bp, Homo sapiens
  misc_feature: GZ8MTXP01ACF9P.4.37.D04.1.454.CMB.2.raw
  modified_base (228)..(228): a, c, t, g, unknown or other
  modified_base (254)..(254): a, c, t, g, unknown or other
  modified_base (633)..(633): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggacgcccactcccaggtgcagctggtgcagtcgtggggctggaggtgaagagccgtggggcctnagtgaaggtctctgcaaggtcttcgngactacaccttcaccgtcctactatatgcacgtgggcgcgtacgtcggcccctaggaccgagggtcttaggacggtggagtgggatcggacctccgaccgtaagacggtcggtaacgaccaagaaagtgcgaccaagtaggtaaacgtttcggacggggtcgaacggggtaccacgtacgtacggaacccggacgggtaaccgtacccgttacgaacgtaccgaacgaccgtacccggggttaaccacggtaccaacggaccacgaccgacctaacgtacggtccggaaccgttcggaaccggtccggtaccgttacggacttacgttcggtaacggaccggttaccgttaccggtaaccggttattcgtttaccgggngggttacggtaacgggaagggtaag

SEQ ID NO: 402191 - DNA, 602 bp, Homo sapiens
  misc_feature: GZ8MTXP01EXQA1.4.37.D04.1.454.CMB.2.raw
  modified_base (226)..(226): a, c, t, g, unknown or other
  modified_base (250)..(250): a, c, t, g, unknown or other
  modified_base (392)..(392): a, c, t, g, unknown or other
  modified_base (587)..(587): a, c, t, g, unknown or other
  modified_base (594)..(594): a, c, t, g, unknown or other
  modified_base (598)..(598): a, c, t, g, unknown or other
  modified_base (601)..(601): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctnagtgaggtctcctgcaaggcttgngatacaccttcaccgcctactatatgctacgtgggtcgcgacgtcggccccgtaggacgtaaggggtcttaggacggtggagtggggactgggacctaccggaacctaagacggtcgggtacgggacaacgaaaggttacgnggaaccaacgtaaggtaaacggtttccggaaggggcctaaggggtaccaacccgtagacggaacccgaaggggaccacggtcccaaatccgaagccacggtcccagtccgaacgccacgtacgtcctaacagttccggactcggacgcggtcccttggacccaagtccgagaccgcgacggtcgtaatctttggnggttcgngggnggng

SEQ ID NO: 402192 - DNA, 687 bp, Homo sapiens
  misc_feature: GZ8MTXP01CE2F7.4.37.D04.1.454.CMB.2.raw
  modified_base (228)..(228): a, c, t, g, unknown or other
  modified_base (246)..(246): a, c, t, g, unknown or other
  modified_base (252)..(252): a, c, t, g, unknown or other
  modified_base (265)..(265): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggctggaggtgaagagccgtggggctnagtgagtctctgcagctngatacnctcacgctatatngcagtgggtgcgacgtcggcccctaggacgagggtctttaggaggtggagttggggatgggtaacctccggtaacctaacgaggcggtaaggactaacgaaaggtatcgacacgtaaggtacgtttacgaggggcgtaaggggtaccaaccgagttaccggaaccgtaacgggaccgtaaccgtccaagttacgaacggacccaaccggggtaacctaactccgaaacggaccaaccgaaccggtaccttaaaacccggtacgtacccgggtaccgtagggaaccgggtaaccgggtacgttacggaaacccgttagttaacccggtaacgggaacccgttaaccgggttacccgggttaacgtttaaggtttaaccgtttacgggtacggggttacgggtaacggggttaacggggtaagg

SEQ ID NO: 402193 - DNA, 682 bp, Homo sapiens
  misc_feature: GZ8MTXP01EF9ZU.4.37.D04.1.454.CMB.2.raw
  modified_base (259)..(259): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcaggtcgtggggctggaggtgaagaagccgtggggcctgagtgaaggtctccgtgacaggtcttcgnggactacaccttcaccgtcctaactatatgactacggtgggtcgccgtacgtccggtaccccgtaggaaccgaagggggtcctttagggagggttggaagttgggggattaggggaccctaccggaacccgtaaaggcggtaccggggtaagacctaagaaaagttagacggaactaacgtaagggttaaacggttttacgacgggggtacgtaacggggtaccaaccgagttacggaaaccggaacgggaaccgtaaccggtacctaacgacaacgaccacggggtaccacgtacaacgacacaccgaccttaacgacgtcggaaccgtaggacgccggaccgttacgaaccgttacgtaccgtacgacgacgaccggtaaccgttattaacgtttcggtggttacggaacggaagggtaag

SEQ ID NO: 402194 - DNA, 740 bp, Homo sapiens
  misc_feature: GZ8MTXP01CYY7J.4.37.D04.1.454.CMB.2.raw
  modified_base (615)..(615): a, c, t, g, unknown or other
  modified_base (734)..(734): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaacgccgtggacgtcctagtaggtaggtacggttcctccgtgacgtaaggtcttacgagtaactacctaccttaccgacccgtactaataagtacgtcgtacgtacggtggggtcgaccgtaccggtcccggtaccccgtagggaacggtaacggggttcgttagggacgggttagggtacggtaggggtacggttaccggtaaccgtacccggtaaacccgtaaagggaccgggttaaccggggtaacggaacctaaaacggtaaaaggttacgtaccgaaccgtaaacggttaaacgggttacggtttacgggacgggacggtaacgggtaccaacgtaggtaaccgaccgggtaacggaccaccgtacacgtaccgaacgacggtaacctacctanaccgacgacccaacgtacgtaacccagtacgggttacccgaccggtagggccggtccggacgtacgaacgtaccgtcgttaaacggcttaacgcggtacttgtacgtggttagtcgggnggtaag

SEQ ID NO: 402195 - DNA, 509 bp, Homo sapiens
  misc_feature: GZ8MTXP01AMPB2.4.37.D04.1.454.CMB.2.raw
  modified_base (327)..(327): a, c, t, g, unknown or other
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctctgcaggcttctggatacaccttcaccgcctactatatgcactgggtgcgactggccccctggacaagggcttgagtggatggatggacncgactaacgagcgtgcaacaaagtatgcacagaagtttcagggtcgagggtcaccatagaccgagggacacgtcaatcagcacggtcatcgagccacacgcctacaatcggacctgagccgggcttaggacagtctcgacgcgacggccgtaattcgttttcgtggttcggcggnggtaagg

SEQ ID NO: 402196 - DNA, 728 bp, Homo sapiens
  misc_feature: GZ8MTXP01DEMTG.4.37.D04.1.454.CMB.2.raw
  modified_base (225)..(225): a, c, t, g, unknown or other
  modified_base (248)..(248): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggctnagtgagtctctgcaaggcttcgnggatacaccttcaccgcctatatatgctacgtggggtcgcgacgtcgggccccctagggaaccgaaggggtcctttaggacggttggagttgggggatcggggtactaccggaaaccctaagacgggccggggttaacgggacctaacgtaaaagttacgtacggaccaaacgtaagggtaaacggtttacgacgggggtacgtaacgggggtaccaaccgtagtacggaaccgaacgggggaccaaccggtacccaagtaccgaacgacccgaaccggggttacccaaacgtaccgaacggacccaaaccgaccggtaaccccttaaacgaacgttccgggaaacccgttcgggaccgggaaccggggtcccttaacgggaaccgttaacggttacccgtaacggaaacccgttacggaccggtaacccggttaaatttcgttttaaccgggtcggttacggtaacgggaagggtaagg

SEQ ID NO: 402197 - DNA, 676 bp, Homo sapiens
  misc_feature: GZ8MTXP01A60UX.4.37.D04.1.454.CMB.2.raw
  modified_base (258)..(258): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccgaggtgcagctggtgcagtcgtggggctgaggtgaagagcgtgggctcagtgaggtctctgcaggtcttcgtggactaccncttcaccgctactatatgactacgtgggtcgcgacgtccggccccgtagggacgtagggtcgttagagggtggagtggggatcggactacccggacctaaacggcggtcgggtaagacaacgaaaagtgacgtacaacgtaaggtaacgtttcggaggggtcgtacggggtaccacgtaggtacgaacccggaagggtaccaccggtaccagtaccgacgacccgtaaccgggttaccccaagtacaaaccggacccaaccggtaccgaacctttaaaccgaaggttccgggaaacccgttggggaacgggttccggggtacccttaggggaacccttaacggggtcctaacgggaaacgttcggccccgggtaactaaggttcctttcgggtacggttacggtcggttaaggtaagg

SEQ ID NO: 402198 - DNA, 655 bp, Homo sapiens
  misc_feature: GZ8MTXP01D929Q.4.37.D04.1.454.CMB.2.raw
  modified_base (225)..(225): a, c, t, g, unknown or other
  modified_base (244)..(244): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagcgtgggctnagtgagtctctgcaggctngatacacctcaccgctactatatgcacgtgggtcgcgacgtcggccccgtaggacgaagggtctttggaggtggagtggggatcggacctaccgacctaagaggcggtaaggacaacgaaagtatcgacaacgaggtaacgttcgagggtcgaacgggtacaacgagtacggaaaccgacggggaaccaaccgggtaccacgtaccgaacgtaccgtaaccggggttacccaagtaccgaacggacccaaaccgacggtaacccctaacgtacggtaccgggaacccgttcgggaacccgggtcggggacccttacggggaaccttaacggtccgtaacggaaccgaaccggttaccgggtaacccgttattaacgtttacgggtaggttacggtaacggggaagggtaag

SEQ ID NO: 402199 - DNA, 684 bp, Homo sapiens
  misc_feature: GZ8MTXP01AH2WR.4.37.D04.1.454.CMB.2.raw
  modified_base (202)..(202): a, c, t, g, unknown or other
  modified_base (663)..(663): a, c, t, g, unknown or other
tcagagcactgtagcacgaccggtgctcgatttagtagcatactggttgggtttgggggagcatcacccagcaaccacatctgtcctctagagaatcccctgagagctccgttcctcaccatggactggacctggaggatcctcttcttggtggcagcagccacaggacgcccactcccgaggtgcagcgtggtgcagtcgnggggctggaggtagaagacgccgtggggcctgaggtgaacggtcctccgtgacgtaaggtcttcgtaggactaccgacccttccgacccgtcctaactatagtcgactacggtgggtcgacggtaccgtcggaccccgtagggaacgtaaggggtcttaggaggtaggaggtaggggatacgggaccttacccggaaccgtaacggacgggtcgggtaacggaacctaacgtaaaggttcgacgacgaagtacggtaacggtttacggacggggtacgacgggtaccaaccgacgtacggaacccggacgggtaccaccggtaccacgtacgacgaccaccgggtaccagtaccaacggaccaaccgacgtaacctaacgtacgtccggaccgtacgggacgggtcccgaccggttagacgttacgtacgcggaccgcggttaccgtcgtattcgttcggnggttggcggttaagggtaagg

SEQ ID NO: 402200 - DNA, 515 bp, Homo sapiens
  misc_feature: GZ8MTXP01A2V4K.4.37.D04.1.454.CMB.2.raw
  modified_base (228)..(228): a, c, t, g, unknown or other
  modified_base (250)..(250): a, c, t, g, unknown or other
  modified_base (291)..(291): a, c, t, g, unknown or other
  modified_base (359)..(359): a, c, t, g, unknown or other
  modified_base (380)..(380): a, c, t, g, unknown or other
  modified_base (400)..(400): a, c, t, g, unknown or other
  modified_base (454)..(454): a, c, t, g, unknown or other
  modified_base (459)..(459): a, c, t, g, unknown or other
  modified_base (477)..(477): a, c, t, g, unknown or other
  modified_base (487)..(487): a, c, t, g, unknown or other
  modified_base (506)..(506): a, c, t, g, unknown or other
  modified_base (508)..(508): a, c, t, g, unknown or other
  modified_base (510)..(510): a, c, t, g, unknown or other
  modified_base (512)..(512): a, c, t, g, unknown or other
  modified_base (514)..(514): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctctgcaggcttnggatacaccttcacccgtctaactatatgctacgtgggtcncgactcggcccctagggacgaagggtcttaggaggttggactggggaatcggactccggaacctaagngtcggtaagacaacgaaagtngacacaggtagttcgaggtnagggtcacatcgacgaggacacgtccatcagtcaacggtcagtacagacaacgncctangtcggactgacgcggtcnggccaagtcncgacgagccggaatatctngngngngng

SEQ ID NO: 402201 - DNA, 593 bp, Homo sapiens
  misc_feature: GZ8MTXP01BDO80.4.37.D04.1.454.CMB.2.raw
  modified_base (427)..(427): a, c, t, g, unknown or other
  modified_base (483)..(483): a, c, t, g, unknown or other
  modified_base (490)..(490): a, c, t, g, unknown or other
  modified_base (514)..(514): a, c, t, g, unknown or other
  modified_base (528)..(528): a, c, t, g, unknown or other
  modified_base (560)..(560): a, c, t, g, unknown or other
  modified_base (575)..(575): a, c, t, g, unknown or other
  modified_base (584)..(584): a, c, t, g, unknown or other
  modified_base (586)..(586): a, c, t, g, unknown or other
  modified_base (590)..(590): a, c, t, g, unknown or other
  modified_base (592)..(592): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggacctcgagtgaacggttctccgtgacaaggtcttcgtggactacgcccttcaccgtcctactatactgacctagtgggtcgaccgacgtcgggaccccgtagggaccgtaaggggtctttaggaggtggtagttaggggatttcggggactacccggtaacccgtaaagcgggtccgggtaacgggaccaaccgtaaaagtntaccgacaagtacgtaagtttcgagggtcgagggtcaccagtcgaacgagggtacncgacacncaacgcacgggtacaacgcacganacgacgttccaacngtacgctggaagtcgcgttggaccagcccganaccggttacgacgtntagtcgtgngngcgngng

SEQ ID NO: 402202 - DNA, 667 bp, Homo sapiens
  misc_feature: GZ8MTXP01BMDQY.4.37.D04.1.454.CMB.2.raw
  modified_base (656)..(656): a, c, t, g, unknown or other
  modified_base (662)..(662): a, c, t, g, unknown or other
  modified_base (664)..(664): a, c, t, g, unknown or other
  modified_base (666)..(666): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaacgccgtggggcctgagtgaacggtctctgacgaaggtcttcgtggactaccaccttcacccgtcctaactatactgccacggtgggtcgccgtacgtcgggccccgtagggaaccgtaaggggtctttaggacggtagggtagtgggggaagttcgggaaccttacccggaaccgtaaagcgggccggggttaacggaacccaacgtaaaggttactgggacctaacggaaggttaacggtttaccggaggggtaccgaacggggttaccaaccgtagtacggaaacccggtaaggggacctacccggtacactacgacgtaccaccggggtacacgtaccgacgaccaccgacgtaccgtaacacggttcggaccgtcggcgggtaaccgggcgttcgaccgttaggcgaacgacgttgccggtaatcgtaattcggngttcgngngng

SEQ ID NO: 402203 - DNA, 595 bp, Homo sapiens
  misc_feature: GZ8MTXP01DYA63.4.37.D04.1.454.CMB.2.raw
  modified_base (302)..(302): a, c, t, g, unknown or other
  modified_base (375)..(375): a, c, t, g, unknown or other
  modified_base (396)..(396): a, c, t, g, unknown or other
  modified_base (485)..(485): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggacgcccacctcccaggtgcagctggtgcagtcgtgggctggaggtagaagaacgccgtggggcctcgagtgaaggtctctgacgagtcttcgtggactacaccttcacccgtcctaatatatcgacgacgttggggnaccgtacgtccggaccccgtaggacgaagggtctttaggaggtaggagtgggatcggactcccgaactaacgngcggtaacgacaagaaagtanagacagagtagttcgagggacgaggtacacgagtgaacgaggacacgtacagcagccgacgtacatacacgacaacgacgaccctaaancgtacggaccgtggaccgggtccggacgttacggaaccttacggttccgaacggaacgttaccgacgggtaaccttagttcttcggtaggttccggtaagaagggaacgg

SEQ ID NO: 402204 - DNA, 603 bp, Homo sapiens
  misc_feature: GZ8MTXP01ALWHO.4.37.D04.1.454.CMB.2.raw
  modified_base (199)..(199): a, c, t, g, unknown or other
  modified_base (256)..(256): a, c, t, g, unknown or other
  modified_base (411)..(411): a, c, t, g, unknown or other
  modified_base (445)..(445): a, c, t, g, unknown or other
  modified_base (578)..(578): a, c, t, g, unknown or other
  modified_base (602)..(602): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccgaggtgcagctggtgcagtcgnggggctgaggtgaagaagccgtggggcctgagtgaaggtctcctgcgaaggcttcgnggataccaccttcgaacccgtcctaactatagtgaccgtacgttggggtcgccggtaccgtccgggacccccgtagggaaccgaagggtcgtttaggaggttggacgttggggatggacctaccgaccaagacgcggtaggacaacgaaaggtancgactagagtaacgttcgagggctagggtacacngtacgaccgagggacacgacatcgagccacggtcagtcacgtacacgacgacctaacgagtccggtaccgtgacggccggtcttaggaaccttgttccgacggacgacccggaccggtcctagttctttacgnggttagggtaaccgttaagggggng

SEQ ID NO: 402205 - DNA, 563 bp, Homo sapiens
  misc_feature: GZ8MTXP01ADJLU.4.37.D04.1.454.CMB.2.raw
  modified_base (243)..(243): a, c, t, g, unknown or other
  modified_base (256)..(256): a, c, t, g, unknown or other
  modified_base (270)..(270): a, c, t, g, unknown or other
  modified_base (353)..(353): a, c, t, g, unknown or other
  modified_base (455)..(455): a, c, t, g, unknown or other
  modified_base (481)..(481): a, c, t, g, unknown or other
  modified_base (489)..(489): a, c, t, g, unknown or other
tcagagcactgtagcacgaccggtgctcgatttagtagcatactgttgggtttgggggagcatcacccagcaaccacatctgtcctctagagaatcccctgagagcctccgttcctcaccatggactggacctggaggatcctcttcttggtggcagcagccacaggagcccactcccaggtgcagctggtgcaggtcgtggggctggaggtagaagaagccgtggggcctcagtgaaggtcncctgcaggcttgngatacacctcaccnctactagatgacacgtggtagccgacgtcggcccctaggacgaggtcttgaaggtggactgggatgggactaccgaccgtaanacggcggtaggcaacgaaagtctgactagagtaagttcgagggtacgacgggtacaccgatacggaaccgaagggactaccgacagtccagccacgggtcancaacgcacacgcctatgcgaacccgngcgcgacncgacttacgtcgtacgaccgacgaccggtaaccttaggtaacgtttcggtacggttagtcgggaacgggtaagg

SEQ ID NO: 402206 - DNA, 514 bp, Homo sapiens
  misc_feature: GZ8MTXP02GIFE1.4.37.D04.1.454.CMB.2.raw
  modified_base (225)..(225): a, c, t, g, unknown or other
  modified_base (249)..(249): a, c, t, g, unknown or other
  modified_base (286)..(286): a, c, t, g, unknown or other
  modified_base (337)..(337): a, c, t, g, unknown or other
  modified_base (344)..(344): a, c, t, g, unknown or other
  modified_base (349)..(349): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaggtctcctgcaaggcttcnggatacaccttcaccgcctactatatgcacgtgggtncgactggcccctggacaaggcttggagtggatggatggactcgaccctagngcgtgcnaagtntgacacagaagtttcgaggcagggtcacgagtcgacgaggacacgtcatcgagcacgtcatcagtcacgacgtcctacacgtcgaccgtggaacgcggtactaggaccgtagtcgtacgacgtacgaccggtcgtagtacgttcgtacgtcgaccggaggtacgg

SEQ ID NO: 402207 - DNA, 480 bp, Homo sapiens
  misc_feature: GZ8MTXP02GRYC7.4.37.D04.1.454.CMB.2.raw
  modified_base (334)..(334): a, c, t, g, unknown or other
  modified_base (344)..(344): a, c, t, g, unknown or other
  modified_base (421)..(421): a, c, t, g, unknown or other
  modified_base (470)..(470): a, c, t, g, unknown or other
tcagagcactgtagcacgaccggtgctcgatttagtagcatactgttgggtttgggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctanagcggtggcncaaagtatgcacagaagtttcagggcagggtcacatgaccagggacacgtcatcagcacgtcatcagcacagcctanatggacctgagcggcctggacagtctgacgacgacggccgtatacttcngtgcgaggag

SEQ ID NO: 402208 - DNA, 480 bp, Homo sapiens
  misc_feature: GZ8MTXP02I4V9W.4.37.D04.1.454.CMB.2.raw
  modified_base (335)..(335): a, c, t, g, unknown or other
  modified_base (352)..(352): a, c, t, g, unknown or other
  modified_base (463)..(463): a, c, t, g, unknown or other
  modified_base (471)..(471): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacagggcttgagtggatgggatggatcgacctanagcggtgcacgaaagtntgcacagaagtttcgaggcaggtcacatgacagggacacgtcatcagcacgtcatcagcacagacctacatcggacctgacgcggcgtggacgaaggcgacgacgagacgngctactcngcgcgagng

SEQ ID NO: 402209 - DNA, 493 bp, Homo sapiens
  misc_feature: GZ8MTXP02HM1AT.4.37.D04.1.454.CMB.2.raw
  modified_base (483)..(483): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacccgcctactatatgcactgggtgcgactcggcccctggacaagggcttgagtggatgggatggactcgacctaagagcggtggcacaaagtatgcacagtaagtttcgagggcagggtcaccgatgacgagggacacgtcatcagcacgtccatcagacacacgcctacagtggacctgacgcggctgacagcgtacgacgacgacgcgtatattcgngtgcgaggag

SEQ ID NO: 402210 - DNA, 488 bp, Homo sapiens
  misc_feature: GZ8MTXP02IDL9B.4.37.D04.1.454.CMB.2.raw
  modified_base (282)..(282): a, c, t, g, unknown or other
  modified_base (332)..(332): a, c, t, g, unknown or other
  modified_base (344)..(344): a, c, t, g, unknown or other
  modified_base (422)..(422): a, c, t, g, unknown or other
  modified_base (470)..(470): a, c, t, g, unknown or other
  modified_base (473)..(473): a, c, t, g, unknown or other
  modified_base (476)..(476): a, c, t, g, unknown or other
  modified_base (479)..(479): a, c, t, g, unknown or other
  modified_base (487)..(487): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaaggtctcctgcaaggcttctggatacaccttcaccgcctacatatgcactgggtncgactcggcccctggacaagggcttgagtggatgggatggatcgacctangcgtgcacagtntgcacagaagtttcagggcagggtcaccatacgaccagggacacgtccatcagcacgtccatcagcacacgtcctaanacgtcggactggacgcggcgtacggacgacgcgacgacgacgcgacgngtntcncgngcgagagng

SEQ ID NO: 402211 - DNA, 487 bp, Homo sapiens
  misc_feature: GZ8MTXP02HNZHQ.4.37.D04.1.454.CMB.2.raw
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatggatggatcgacctaacagcggtggcacaaagtatgcaacgagaagtttcagggcagggtcacatgacagggacacgtcatcagcacgtccatcagcacacgcctacatggacctgacgcggctgacaagtcacgacgacgacggccgtatacttctgtcggcgaggag

SEQ ID NO: 402212 - DNA, 476 bp, Homo sapiens
  misc_feature: GZ8MTXP02HNP0Y.4.37.D04.1.454.CMB.2.raw
  modified_base (336)..(336): a, c, t, g, unknown or other
  modified_base (425)..(425): a, c, t, g, unknown or other
  modified_base (447)..(447): a, c, t, g, unknown or other
  modified_base (461)..(461): a, c, t, g, unknown or other
  modified_base (469)..(469): a, c, t, g, unknown or other
  modified_base (475)..(475): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaanagcggtggcacaaagtatgcacagaagtttcagggcagggtcacatgaccagggacacgtcatcagcacgtccatcagcacagcctacntgacctgagcggctggacagcncgacgacgagcganacttctgngcgagng

SEQ ID NO: 402213 - DNA, 495 bp, Homo sapiens
  misc_feature: GZ8MTXP02HBXL2.4.37.D04.1.454.CMB.2.raw
  modified_base (252)..(252): a, c, t, g, unknown or other
  modified_base (287)..(287): a, c, t, g, unknown or other
  modified_base (338)..(338): a, c, t, g, unknown or other
  modified_base (454)..(454): a, c, t, g, unknown or other
  modified_base (494)..(494): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacatggaggatcctcttcttggtggcagcagccacaggagcccactcccaggtgcagctggtgcagtctgggggctgaggtgaagaagcctggggcctcagtgaaggtctcctgcaaggcttcnggatacaccttcaccgctactatatgcactgggtncgactggcccctggacaagggcttgagtggatgggatggatcgacctaacngcggtggcaacaaagtatgcaacagaagttcgagggcagggtcacgatagaccagggacacgtccatcagcaacgtcatacagcacacgcctacatggacctggacgccgggaccncgacacgtcgacgacgacgaacgctatactcgtcgcgagng

SEQ ID NO: 402214 - DNA, 480 bp, Homo sapiens
  misc_feature: GZ8MTXP02F9E5T.4.37.D04.1.454.CMB.2.raw
  modified_base (357)..(357): a, c, t, g, unknown or other
  modified_base (471)..(471): a, c, t, g, unknown or other
  modified_base (473)..(473): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttggagtggatgggatggactcgaccctaagagcggtgcacgaaagtntgacacagtaagttcagggcagggtcacatcgacaggacacgtcatcagcacgtcatcagcacagctacatggacctgacgcggctggcaagcgcgacgacgacgcgtatctcngngcgagng

SEQ ID NO: 402215 - DNA, 549 bp, Homo sapiens
  misc_feature: GZ8MTXP02H3X9E.4.37.D04.1.454.CMB.2.raw
  modified_base (373)..(373): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacgaggacgcccacctcccaggtgcagctggtgcagtcgtggggctggaggtgaagaagccgtggggcctcgagtgaaggtctcctgcgaaggtcttcgtggatacaccttcaccgtcctactatatgccacgtgggtgcgactcggcccctggacaagggcttgagtgaagtgggatggactccgaaccctagaggcggtggcacgaaagtntgacacagaaagtttcgaggcgagggtacacgatacgaccgagggacaccgtaccatacacgacaccggtacctatacagaccaacgacgaccctaacaagttaacgacctacgaacggcggaccgtcggacaacgtcgtacgacgacgacggccgtaatcttctgtagcgaggag

SEQ ID NO: 402216 - DNA, 489 bp, Homo sapiens
  misc_feature: GZ8MTXP02F7JLR.4.37.D04.1.454.CMB.2.raw
  modified_base (287)..(287): a, c, t, g, unknown or other
  modified_base (338)..(338): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtncgactggcccctggacaagggcttgagtggatgggatggatcgaccctaanagcggtgcacaaagtatgacacagaagtttcagggcagggtcacatgaccaggacacgtcatcagcacgtcatcagcacagcctacatggacctgacgcggcctaggaccaagtcgacgaacgacgacgcgtatattcgtgtcggcgagag

SEQ ID NO: 402217 - DNA, 472 bp, Homo sapiens
  misc_feature: GZ8MTXP02IVJET.4.37.D04.1.454.CMB.2.raw
  modified_base (222)..(222): a, c, t, g, unknown or other
  modified_base (329)..(329): a, c, t, g, unknown or other
  modified_base (462)..(462): a, c, t, g, unknown or other
  modified_base (471)..(471): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctnagtgaggtctctgcaggctctggatacacttcaccgcctactatatgcactgggtgcgactcggcccctggacaagggcttgagtggatgggatggatcgaccctanagcggtggcacaaagtatgacacagaagtttcgagggcaggtcacatgacagggacacgtccatcagcacgtcatcagcacagcctacatgacctgacgcggctgacagctacgacgacgacgcgtatattcngtcgcgagng

SEQ ID NO: 402218 - DNA, 499 bp, Homo sapiens
  misc_feature: GZ8MTXP02IVE5V.4.37.D04.1.454.CMB.2.raw
  modified_base (343)..(343): a, c, t, g, unknown or other
  modified_base (488)..(488): a, c, t, g, unknown or other
  modified_base (498)..(498): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaagtctcctgcaaggcttctggatacaccttcaccgcctactatatgcactgggtgcgactcggccccctggacaagggcttggagtggatggggatggactcgaccctaanggcggtggcacgaaagtatgacacagtaaagtttcgagggcagggtcacagtgacgaggacacgtacatcagcacgtccatcagcacacgcctacatcggacctgacgcggcctggacagtcgtacgacacgacgcgtatattcngtcgcgaggng

SEQ ID NO: 402219 - DNA, 484 bp, Homo sapiens
  misc_feature: GZ8MTXP02I7F56.4.37.D04.1.454.CMB.2.raw
  modified_base (334)..(334): a, c, t, g, unknown or other
  modified_base (352)..(352): a, c, t, g, unknown or other
  modified_base (422)..(422): a, c, t, g, unknown or other
  modified_base (452)..(452): a, c, t, g, unknown or other
  modified_base (473)..(473): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcaccgcctactatatgcactgggtgcgactggcccctggacagggcttgagtggatgggatggatcgacctaanagcggtggcacgaaagtntgacacagtaagtttcgagggcagggtcacgatgaccagggacacgtccatcagcacgtccatcagcacngacctacatgacctgagcggctgacagtcncgacgcacgccgtatacttcngtcgcgaggag

SEQ ID NO: 402220 - DNA, 483 bp, Homo sapiens
  misc_feature: GZ8MTXP02G71QO.4.37.D04.1.454.CMB.2.raw
  modified_base (335)..(335): a, c, t, g, unknown or other
  modified_base (352)..(352): a, c, t, g, unknown or other
  modified_base (448)..(448): a, c, t, g, unknown or other
  modified_base (467)..(467): a, c, t, g, unknown or other
  modified_base (469)..(471): a, c, t, g, unknown or other
  modified_base (473)..(474): a, c, t, g, unknown or other
  modified_base (476)..(476): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatggatggatcgacctanagcggtgcacaaagtangccagagaaaggtttcggggcagggtcaccgatgaccgagggacacgtcatcagcacgtccatcagcacacgcctacatcggacctgacgcgggcnggacacgcgacgacgacgngnnntnngngngngng

SEQ ID NO: 402221 - DNA, 480 bp, Homo sapiens
  misc_feature: GZ8MTXP02GH1TV.4.37.D04.1.454.CMB.2.raw
  modified_base (465)..(465): a, c, t, g, unknown or other
  modified_base (467)..(467): a, c, t, g, unknown or other
  modified_base (472)..(473): a, c, t, g, unknown or other
  modified_base (475)..(475): a, c, t, g, unknown or other
  modified_base (477)..(477): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaacagcggtggcacaaagtatgcacagaaagtttcagggcagggtcacatgaccagggacacgtccatcagcacgtccatcagcacagcctacactggacctgacgcggctggacaaggcgcgacgagcgngnactcnngngngng

SEQ ID NO: 402222 - DNA, 478 bp, Homo sapiens
  misc_feature: GZ8MTXP02FYJ60.4.37.D04.1.454.CMB.2.raw
  modified_base (226)..(226): a, c, t, g, unknown or other
  modified_base (251)..(251): a, c, t, g, unknown or other
  modified_base (287)..(287): a, c, t, g, unknown or other
  modified_base (335)..(335): a, c, t, g, unknown or other
  modified_base (350)..(350): a, c, t, g, unknown or other
  modified_base (443)..(443): a, c, t, g, unknown or other
  modified_base (466)..(466): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttcnggatacaccttcaccgcctactatatgcactgggtncgactggcccctggacaagggcttgagtgatggatggatcgaccctanagcgtgcacaaagtngcacagaagttcaggcaggtcacatgacagggacacgtcatcagcacgtccatcagcacagcctacatggacctgacgcggcctggacagtcncgacgacgacggccgtatattcngtcgcgaggagg

SEQ ID NO: 402223 - DNA, 482 bp, Homo sapiens
  misc_feature: GZ8MTXP02JX4F3.4.37.D04.1.454.CMB.2.raw
  modified_base (338)..(338): a, c, t, g, unknown or other
  modified_base (449)..(449): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaanagcggtggcacgaaagtatgcacagaaagtttcagggcagggtcacatgacaggacacgtcatcagcacgtcatcagcacagcctacatggacctgacgcggctgcagtcncgacgacgacgcgtatacttctgtgcgaggagg

SEQ ID NO: 402224 - DNA, 518 bp, Homo sapiens
  misc_feature: GZ8MTXP02I3YQO.4.37.D04.1.454.CMB.2.raw
  modified_base (403)..(403): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgctactatatgcactggtgcgactggcccctggacaagggcttgagtggatgggatggatcgaccctaacagcggtgcacaaaagtatgcacagaaagtttcaagggcaggtcaaccatgaccagggacacgtccancagcacgtcatcagacacacgacctaacagtacgacgtacgacggacggaccgtacgacgaacgtacgtacgaacgaacgacgaacgtacgttacttacgtgtcgtacggaggag

SEQ ID NO: 402225 - DNA, 504 bp, Homo sapiens
  misc_feature: GZ8MTXP02G2G8S.4.37.D04.1.454.CMB.2.raw
  modified_base (251)..(251): a, c, t, g, unknown or other
  modified_base (357)..(357): a, c, t, g, unknown or other
  modified_base (435)..(435): a, c, t, g, unknown or other
  modified_base (494)..(494): a, c, t, g, unknown or other
  modified_base (503)..(503): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcactgggtgcgactggcccctggacaagggcttgagtggatgggatggactcgaccctaagaggcggtggcacaaagtntgcacagaagtttcaggggcaggggtcaccgatcgaccgagggacacgtccatcagcacgtcatcagcacgagcctanacgtcggacctgacggccggcctaggaccaagtcgacgacgacgacgcgtatacttcgngcgcgaggng

SEQ ID NO: 402226 - DNA, 479 bp, Homo sapiens
  misc_feature: GZ8MTXP02HQI9R.4.37.D04.1.454.CMB.2.raw
  modified_base (415)..(415): a, c, t, g, unknown or other
  modified_base (450)..(450): a, c, t, g, unknown or other
  modified_base (475)..(475): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacatggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaacagcggtgcacaaagtatgcacagaagttcagggcagggtcacatgaccaggacacgtccatcagcacgtcatcagcacngacctacatggacctgacgcggacctggacagtcncgacacgaagccgtatatctgtcgngagg

SEQ ID NO: 402227 - DNA, 484 bp, Homo sapiens
  misc_feature: GZ8MTXP02HD8L8.4.37.D04.1.454.CMB.2.raw
  modified_base (335)..(335): a, c, t, g, unknown or other
  modified_base (351)..(351): a, c, t, g, unknown or other
  modified_base (473)..(473): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctanagcggtgcacaaagtntgcacagaaagtttcagggcagggtcacgatgacagggacacgtcatcagcacgtccatcagcacagcctacatggacctgacgcggcctggacagtctcgacgacacggccgtatacttcngtcgcgaggag

SEQ ID NO: 402228 - DNA, 485 bp, Homo sapiens
  misc_feature: GZ8MTXP02F9HS0.4.37.D04.1.454.CMB.2.raw
  modified_base (337)..(337): a, c, t, g, unknown or other
  modified_base (354)..(354): a, c, t, g, unknown or other
  modified_base (451)..(451): a, c, t, g, unknown or other
  modified_base (474)..(474): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaanagcggtggcacaaagtntgcacagaagtttcagggcagggtcacatgacagggacacgtcatcagcacgtccatcagcacagcctacatggacctgacgcggcctggacagtcncgacacgacggccgtatattcgngtcgcgaggag

SEQ ID NO: 402229 - DNA, 493 bp, Homo sapiens
  misc_feature: GZ8MTXP02HJC5G.4.37.D04.1.454.CMB.2.raw
  modified_base (483)..(483): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggactcgaccctaagagcggtggcacaaagtatgacacagaaagtttcaggggtcagggtcaccgatgacgaggacacgtccatcagcacgtccatcagcacagcctacatcggacctgacgcggactggacagtcgcgacgacgacgcgatacgttcngcgacgagag

SEQ ID NO: 402230 - DNA, 483 bp, Homo sapiens
  misc_feature: GZ8MTXP02JCS5Q.4.37.D04.1.454.CMB.2.raw
  modified_base (223)..(223): a, c, t, g, unknown or other
  modified_base (244)..(244): a, c, t, g, unknown or other
  modified_base (328)..(328): a, c, t, g, unknown or other
  modified_base (344)..(344): a, c, t, g, unknown or other
  modified_base (405)..(405): a, c, t, g, unknown or other
  modified_base (418)..(418): a, c, t, g, unknown or other
  modified_base (425)..(425): a, c, t, g, unknown or other
  modified_base (436)..(436): a, c, t, g, unknown or other
  modified_base (470)..(470): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctnagtgagtctctgcaggcttcnggatacaccttcaccgcctactatatgcactgggtgcgactggcccctggacaaggcttgagtggatggatggactcgacctanagcgtgcacgaaagtngacaacagaaagtttcgagggcgaggtcacgatcgacaggacacgtcatcagcacgtccancagcacgacacanagcgacngacgcgacganacacgcgacgacgacgacgtaacgtactcgtcgngacgacggaggag

SEQ ID NO: 402231 - DNA, 487 bp, Homo sapiens
  misc_feature: GZ8MTXP02JA3F6.4.37.D04.1.454.CMB.2.raw
  modified_base (334)..(334): a, c, t, g, unknown or other
  modified_base (425)..(425): a, c, t, g, unknown or other
  modified_base (478)..(478): a, c, t, g, unknown or other
  modified_base (482)..(482): a, c, t, g, unknown or other
  modified_base (486)..(486): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaaggtctcctgcaaggcttctggatacaccttcaccgcctactatatgcactgggtgcgactggcccctggacaagggcttgagtggatgggatggatcgacctanagcggtggcacaaagtatgcacagaagtttcggggcagggtcaccgatgacagggaccacgtcatcagcacgtccatcagcacagcctacntcggacctgacgcggctggacacgtcgacgacgacgcgcgtaatcgttctcgngcgngagng

SEQ ID NO: 402232 - DNA, 486 bp, Homo sapiens
  misc_feature: GZ8MTXP02IICWP.4.37.D04.1.454.CMB.2.raw
  modified_base (338)..(338): a, c, t, g, unknown or other
  modified_base (427)..(427): a, c, t, g, unknown or other
  modified_base (453)..(453): a, c, t, g, unknown or other
  modified_base (475)..(475): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaanagcggtggcacaaagtatggacacagaaagtttcgaggcaggtcacatgacagggacacgtcatcagcacgtccatcagcacagcctanatgacctgacgcggctaggacagtcncgacgacacggcgtatacttcngtgcgaggagg

SEQ ID NO: 402233 - DNA, 567 bp, Homo sapiens
  misc_feature: GZ8MTXP02IRGI3.4.37.D04.1.454.CMB.2.raw
  modified_base (342)..(342): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcacccgctactatatgcactgggtgcgactcggcccctggaccaagggcttgagtggatgggatggactcgaccctaanagcggtggacacgaaagtatgacacaagtaaagtttcgaggggacaggggtaccaaccgagtcgaccgaaggggaaccacggtacccaagtccaaggccaacgtcccaataccaggaccaacacgtacctaacgaacttcggaacctgaaggccgggctacggacaacgttcgacgaaccgaccacggaaccgttataactttcgtgtacggcggtaagggaagg

SEQ ID NO: 402234 - DNA, 487 bp, Homo sapiens
  misc_feature: GZ8MTXP02FP8ZY.4.37.D04.1.454.CMB.2.raw
  modified_base (335)..(335): a, c, t, g, unknown or other
  modified_base (345)..(345): a, c, t, g, unknown or other
  modified_base (352)..(352): a, c, t, g, unknown or other
  modified_base (395)..(395): a, c, t, g, unknown or other
  modified_base (406)..(406): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggctgagtgatgggatggatcgacctaanagcggtgcanaaagtangcacagaagtttcagggcaggtcacatgacagggacacgtcancagcacgtcancagcacagcctacatggacctgacgcgggcctaggacgaacgcgtacgaacgacgacggcgtatatcgtgcggacgaggag

SEQ ID NO: 402235 - DNA, 482 bp, Homo sapiens
  misc_feature: GZ8MTXP02I1HRL.4.37.D04.1.454.CMB.2.raw
  modified_base (285)..(285): a, c, t, g, unknown or other
  modified_base (351)..(351): a, c, t, g, unknown or other
  modified_base (422)..(422): a, c, t, g, unknown or other
  modified_base (462)..(462): a, c, t, g, unknown or other
  modified_base (469)..(469): a, c, t, g, unknown or other
  modified_base (472)..(473): a, c, t, g, unknown or other
  modified_base (477)..(477): a, c, t, g, unknown or other
  modified_base (481)..(481): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtncgactggcccctggacaagggcttgagtggatgggatggatccgacctacagcggtggcacaagtntgcacagaagtttcagggcagggtcaccatgaccaggacacgtcatcagcacgtccatcagcacagcctanatcggacctgacgcgggctggacaaggcgacgacgtacgngcaagtntcnngcgngagng

SEQ ID NO: 402236 - DNA, 519 bp, Homo sapiens
  misc_feature: GZ8MTXP02J0HPH.4.37.D04.1.454.CMB.2.raw
  modified_base (254)..(254): a, c, t, g, unknown or other
  modified_base (372)..(372): a, c, t, g, unknown or other
  modified_base (453)..(453): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtgggcctcagtgaaggtctccgtgcgaaggtcttcnggataccaccttccaccgcctactatatgcacgtgggtcgcgacgtcggcccctggacagggcttggagtggagtgggagtggactccgaccctaagcggcggtcggacacgaaagtntgcaacgagtagttcgagggcgagggtcacgatcgacgaggacacgtacactcacgcacgtccatcagcacacgaccacgngtcgactcgacgccggctagacgacgtcgacgacgacgacgcgtagtcttcgtagtcgcggaggag

SEQ ID NO: 402237 - DNA, 496 bp, Homo sapiens
  misc_feature: GZ8MTXP02H1YT8.4.37.D04.1.454.CMB.2.raw
  modified_base (357)..(357): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctcctgcaaggcttctggatacaccttcaccgcctactatatgcacgtgggtgcgactcggcccctggacaagggcttggagtggatgggatggactcgaccctaagagcggtgcagaaagtntgcacgagtaaagtttcgagggcagggtcacagtgacagggacacgtcatcagcacgtcatcagcacagcctacatgactgagccggactggactaagctacgacgacgacggtaaccgtatattctggcgacgaggng

SEQ ID NO: 402238 - DNA, 486 bp, Homo sapiens
  misc_feature: GZ8MTXP02GFUER.4.37.D04.1.454.CMB.2.raw
  modified_base (353)..(353): a, c, t, g, unknown or other
  modified_base (379)..(379): a, c, t, g, unknown or other
  modified_base (474)..(474): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaggcttgagtggatgggatggatcgaccctaagagcggtggcacaaagtntgcacagagttcagggcaggtcacangacaggacacgtcatcagcacgtcatcagcacacgacctacactcggacctgacgcggcctggacacgtcgtcgacgacgacgccgtatattcgngtcgacgaggag

SEQ ID NO: 402239 - DNA, 503 bp, Homo sapiens
  misc_feature: GZ8MTXP02F1CKX.4.37.D04.1.454.CMB.2.raw
  modified_base (253)..(253): a, c, t, g, unknown or other
  modified_base (356)..(356): a, c, t, g, unknown or other
  modified_base (489)..(489): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcnggatacaccttcaccgcctactatatgcactgggtgcgactcggcccctggacaagggcttgagtggatggatggactcgacctagagcggtgcacgaaagtntgacacgagtaagttcgagggtcaagggtaaccagtcgaccgaggacacgtcatacagcacgtcactcagcacacgcctacactcgacctagacgcggctggacacgtcacgacgacgcgacgtaatacgtcngtgacgagggagag

SEQ ID NO: 402240 - DNA, 507 bp, Homo sapiens
  misc_feature: GZ8MTXP02HHUD5.4.37.D04.1.454.CMB.2.raw
  modified_base (363)..(363): a, c, t, g, unknown or other
  modified_base (369)..(369): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcgtggataccaccttcacccgcctactatatgcacgtgggtgcgacgtcggcccctggacaagggcttggagtggatgggatggactcgacctagagcggtgcacgaaagtntgacanagtagttcgagggcgaggtcaacgatcgacgagggacacgtcatcgagcacgtccagtcagcacagcctacagtcgactgacgcggctggacagtcgcgaacgacgacggtccgtatacgtttcgngcgacggaggag

SEQ ID NO: 402241 - DNA, 514 bp, Homo sapiens
  misc_feature: GZ8MTXP02J04YN.4.37.D04.1.454.CMB.2.raw
  modified_base (340)..(340): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactggcccctggacaagggcttgagtggatgggatggactcgacctaagngcggtgcacaaagtatgcacagtaagttcgagggcagggtcacagtgacgagggacacgtaccatacagcacgtccatcacgacacacgacctacacgtcggacctggacgccggtccgtaggaccaagtccgacgaccgacgacggccgtatacgttcgtagtggacgaggag

SEQ ID NO: 402242 - DNA, 495 bp, Homo sapiens
  misc_feature: GZ8MTXP02HRT0L.4.37.D04.1.454.CMB.2.raw
  modified_base (341)..(341): a, c, t, g, unknown or other
  modified_base (359)..(359): a, c, t, g, unknown or other
  modified_base (468)..(468): a, c, t, g, unknown or other
  modified_base (480)..(480): a, c, t, g, unknown or other
  modified_base (486)..(486): a, c, t, g, unknown or other
  modified_base (494)..(494): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacccgcctactatatgcacgtgggtgcgactcggcccctggacaagggcttgagtggatgggatggactcgaccctanagcggtggcacgaaagtntgacaacagaagtttcgagggcagggtcaccatgacgagggacacgtcatcagcacgtccatcagacacacgacctacatcggactgacgcggccgtggacaggaccgngacgagacgcgntactcngcgcgagng

SEQ ID NO: 402243 - DNA, 496 bp, Homo sapiens
  misc_feature: GZ8MTXP02H7VEB.4.37.D04.1.454.CMB.2.raw
  modified_base (338)..(338): a, c, t, g, unknown or other
  modified_base (386)..(386): a, c, t, g, unknown or other
  modified_base (413)..(413): a, c, t, g, unknown or other
  modified_base (437)..(437): a, c, t, g, unknown or other
  modified_base (484)..(484): a, c, t, g, unknown or other
tcagagcactgtagcacgaccggtgctcgatttagtagcatactgttgggttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcactgggtgcgactggcccctggacaagggcttgagtggatgggatggactcgaccctaanaggcggtggcacaaagtatgacacagaaagtttcaggcgaggtcacangacgaggactacgcatcagcacgtcancagcacacgcctacacgagacccngaacgcggtcaggacacgtcacgacgaacacggccgtatacgttcgngtcgacgaggag

SEQ ID NO: 402244 - DNA, 495 bp, Homo sapiens
  misc_feature: GZ8MTXP02J5OJ2.4.37.D04.1.454.CMB.2.raw
  modified_base (342)..(342): a, c, t, g, unknown or other
  modified_base (352)..(352): a, c, t, g, unknown or other
  modified_base (354)..(355): a, c, t, g, unknown or other
  modified_base (359)..(359): a, c, t, g, unknown or other
  modified_base (409)..(409): a, c, t, g, unknown or other
  modified_base (417)..(417): a, c, t, g, unknown or other
  modified_base (487)..(487): a, c, t, g, unknown or other
  modified_base (492)..(492): a, c, t, g, unknown or other
  modified_base (494)..(494): a, c, t, g, unknown or other
tcagagcactgtagcacgaccggtgctcgatttagtagcatactgttgggtttgggtagcatcaccagcaaccacatctgtcctctagagaatcccctgagagctccgttcctcaccatggactggacctggaggatcctcttcttggtggcagcagccacaggagcccactcccaggtgcagctggtgcagtctggggctggagtgaagaagcctgggcctcagtgaaggtctcctgcaaggcttctggataccaccttcacccgcctactatatgcactgggtgcgactggccccctggacgcagggtctgagtggatgggactggactccgactaacgngcggtgcaanannaganagtagtacgtagacgtacgcgacgacgacacgacgacgaccgacgacacncacacacncacacacacacacacacgacgacgacgcgacgcggcgcgacgacgacgacgacgacgaacgcgacgtctntctgngng

SEQ ID NO: 402245 - DNA, 477 bp, Homo sapiens
  misc_feature: GZ8MTXP02FMZLH.4.37.D04.1.454.CMB.2.raw
  modified_base (219)..(219): a, c, t, g, unknown or other
  modified_base (230)..(230): a, c, t, g, unknown or other
  modified_base (243)..(243): a, c, t, g, unknown or other
  modified_base (275)..(275): a, c, t, g, unknown or other
  modified_base (328)..(328): a, c, t, g, unknown or other
  modified_base (342)..(342): a, c, t, g, unknown or other
  modified_base (389)..(389): a, c, t, g, unknown or other
  modified_base (405)..(405): a, c, t, g, unknown or other
  modified_base (420)..(420): a, c, t, g, unknown or other
  modified_base (430)..(430): a, c, t, g, unknown or other
  modified_base (437)..(437): a, c, t, g, unknown or other
  modified_base (443)..(443): a, c, t, g, unknown or other
  modified_base (457)..(457): a, c, t, g, unknown or other
  modified_base (463)..(463): a, c, t, g, unknown or other
  modified_base (466)..(466): a, c, t, g, unknown or other
  modified_base (468)..(468): a, c, t, g, unknown or other
  modified_base (470)..(470): a, c, t, g, unknown or other
  modified_base (474)..(474): a, c, t, g, unknown or other
  modified_base (476)..(476): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgagagcctgggcctnagtgaaggtcncctgcaggcttcngatacactcaccgctactatatgcactgggtncgactggcccctggacagggcttgagtggatgggatggatcccgaccctaagngcggtggcacagtngcagagagtttcagggcagggtcacgatgaccgaggaccacgtccanaccgagccacgtccancagacacacgcctanagtcgaccgngcgcgcngacacncgacgacgacgcgngtaatntgngngngagngng

SEQ ID NO: 402246 - DNA, 510 bp, Homo sapiens
  misc_feature: GZ8MTXP02GIKLW.4.37.D04.1.454.CMB.2.raw
  modified_base (501)..(501): a, c, t, g, unknown or other
  modified_base (503)..(503): a, c, t, g, unknown or other
  modified_base (509)..(509): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacgaaggcttggagtggagtgggatggactccgacctaacgaggcggtggacacgaaagtatgacaacagtaagtttcgaggggcagggtcacgagtcgacgagggacacgtccatcgagcacgtcatcagcaacacgcctacacgtcggacctggacggccggcgtggacgagccgacgacgacgcgcgtatctcngngcgagng

SEQ ID NO: 402247 - DNA, 490 bp, Homo sapiens
  misc_feature: GZ8MTXP02GNVQW.4.37.D04.1.454.CMB.2.raw
  modified_base (354)..(354): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacagggcttgagtggatgggatggactcgacctaagagcggtgcacgaaagtntgcacagaagtttcgaggcgaggtcacatgacgaggacacgtcatcagcacgtcatcagcacagcctacagtcgacctgacgcggcctggacagtcgacgacgacgacgaaccgtatacttcgtgtcggcgaggag

SEQ ID NO: 402248 - DNA, 499 bp, Homo sapiens
  misc_feature: GZ8MTXP02HGYN3.4.37.D04.1.454.CMB.2.raw
  modified_base (226)..(226): a, c, t, g, unknown or other
  modified_base (251)..(251): a, c, t, g, unknown or other
  modified_base (357)..(357): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttcnggatacaccttcaccgcctactatatgcacgtgggtgcgactcggcccctggacagggcttggagtggatgggatggactcgaccctagagcggtggcacaaagtntgacacagtaaagtttcgagggcagggtcacatgacgaggacacgtcatcagcacgtccatcagcacacgacctacacgtcggacctgacgcggctggacatcgcgacgacgacggccgtatacttcgtgtcgacgaggagg

SEQ ID NO: 402249 - DNA, 505 bp, Homo sapiens
  misc_feature: GZ8MTXP02GP2RW.4.37.D04.1.454.CMB.2.raw
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctggggcctcagtgaaggtctcctgcaaggcttctggatacaccttcaccgcctactatatgcactgggtgcgactggcccctggacaagggcttgagtggatgggatggatcgacctaacagcggtggcacaaagtatggacacgaaggtaaacgtttcgaggggcgaggggtcaccagtacgaccgaggggacacgtcatcagcacgtcatcagcacacgacctacagtggacctgaacgcggcctggacagtcacgacgacgacgccgtatacttcngtgcgaggag

SEQ ID NO: 402250 - DNA, 495 bp, Homo sapiens
  misc_feature: GZ8MTXP02GHQCP.4.37.D04.1.454.CMB.2.raw
  modified_base (337)..(337): a, c, t, g, unknown or other
  modified_base (483)..(483): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactcggcccctggacagggcttgagtggatgggatggactcgacctaanagcggtggcacaaagtatgacacagaagtttcagggcagggtcacatgaccgaggacacgtcatcagcacgtccatcagcacagcctacatgacctgacgcggctggaccaagtcgacgacgacgacggaaccgtattacttacgngtcgacgaggag

SEQ ID NO: 402251 - DNA, 492 bp, Homo sapiens
  misc_feature: GZ8MTXP02JGFSE.4.37.D04.1.454.CMB.2.raw
  modified_base (338)..(338): a, c, t, g, unknown or other
  modified_base (355)..(355): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaanagcggtggcacaaagtntgcacagtaaagtttcagggcagggtcacatgacagggacacgtcatcagcacgtccatcagcacagcctacatggacctgacgcggcctggaccatctcgaccgacacggccgtatacgttctgtcgacggaggag

SEQ ID NO: 402252 - DNA, 483 bp, Homo sapiens
  misc_feature: GZ8MTXP02GC61C.4.37.D04.1.454.CMB.2.raw
  modified_base (243)..(243): a, c, t, g, unknown or other
  modified_base (330)..(330): a, c, t, g, unknown or other
  modified_base (347)..(347): a, c, t, g, unknown or other
  modified_base (425)..(425): a, c, t, g, unknown or other
  modified_base (469)..(469): a, c, t, g, unknown or other
  modified_base (474)..(474): a, c, t, g, unknown or other
  modified_base (478)..(478): a, c, t, g, unknown or other
  modified_base (482)..(482): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggctcagtgaggtctctgcaggctcngatacaccttcaccgcctactatatgcacgtgggtgcgactcggcccctggacagggcttggagtggatgggatggactcgacctanagcggtgacacaaagtntgacacagtaagtttcgagggcagggtacaccgatcgacagggacacgtcatcagcacgtccatcagcacacgcctanagtcgactgacgcgggctggaccaaggcgacgacgacgcgcgtnactcngcgngagng

SEQ ID NO: 402253 - DNA, 482 bp, Homo sapiens
  misc_feature: GZ8MTXP02I7W5E.4.37.D04.1.454.CMB.2.raw
  modified_base (244)..(244): a, c, t, g, unknown or other
  modified_base (471)..(471): a, c, t, g, unknown or other
  modified_base (481)..(481): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaggtctctgcaaggctcnggatacacttcaccgctactatatgcactgggtgcgactggcccctggacaagggcttgagtggatgggatggatccgaccctacagcggtgcacagtatgcacagaagtttcagggcagggtcacatgaccagggacacggtcatcagcacgtccatcagcacagcctacatggacctgagcggcctggaccagcgacgacgaacgcggaccgaagttcgtctcgngcgacggagng

SEQ ID NO: 402254 - DNA, 571 bp, Homo sapiens
  misc_feature: GZ8MTXP02HETCM.4.37.D04.1.454.CMB.2.raw
  modified_base (346)..(346): a, c, t, g, unknown or other
  modified_base (559)..(559): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctcctgcaaggcttctggatacaccttcaccgcctactatatgcacgtgggtgcgactcggcccctggacaagggcttgagtggagtgggatggactccgaacctagnggcggtgacacaaagtatgacaacgaggtaaacgtttcgaagggcgaggggtaccaaccgtagacgaaccgaaggggaaccgaaccggtaccataccgaagccgaaccgtacccaataccgacgacaacgacgaccctaacgacgtacggacccgtaggaacggccgggaccgtaggacgaacgtccgacgacgacgacgcgtactagttcgngcgacggaggag

SEQ ID NO: 402255 - DNA, 523 bp, Homo sapiens
  misc_feature: GZ8MTXP02ISF4B.4.37.D04.1.454.CMB.2.raw
  modified_base (513)..(514): a, c, t, g, unknown or other
  modified_base (516)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacaagggcttggagtggagtggggatggactccgaccctaacgaggcggtggacacgaaaagtatggaccaacgagtaaagtttcgaggggtacgaggggtacacgagtcgaaccgagggacacgtaccatcagccaccgtccatacacgaccacacgacctacagtacggacctggacggcgggacgtggacgaaggcgacgagtagnngnnnnnnnn

SEQ ID NO: 402256 - DNA, 499 bp, Homo sapiens
  misc_feature: GZ8MTXP02IVUGE.4.37.D04.1.454.CMB.2.raw
  modified_base (253)..(253): a, c, t, g, unknown or other
  modified_base (340)..(340): a, c, t, g, unknown or other
  modified_base (345)..(345): a, c, t, g, unknown or other
  modified_base (360)..(360): a, c, t, g, unknown or other
  modified_base (429)..(429): a, c, t, g, unknown or other
  modified_base (485)..(485): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcnggatacaccttcaccgcctactatatgcacgtgggtgcgactggcccctggacaagggcttgagtggatgggatggactcgacctangcggngcacaaagtatgcanagtaaagttcgaggcagggtcacgatgaccgagggacacgtccatcagcacgtcatcagcacagcctanatcggacctggacgcgctaggacagtcgacgacgacgacggtcgtattacttcggngtcggacggaggag

SEQ ID NO: 402257 - DNA, 512 bp, Homo sapiens
  misc_feature: GZ8MTXP02GW01F.4.37.D04.1.454.CMB.2.raw
  modified_base (250)..(250): a, c, t, g, unknown or other
  modified_base (356)..(356): a, c, t, g, unknown or other
  modified_base (422)..(422): a, c, t, g, unknown or other
  modified_base (499)..(499): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcatgggtgcgactggcccctggacaaggcttgagtggatgggatggactcgacctaacgaggcggtggacacgaaagtntgacacgagtaagtttcgagggcgagggtcaccgagtgaccgaggacacgtccatcagcacgtcancacgcacacgcctacacgttagaccgtgacggcggccgtaggaccaagtcgtacgacgacgacggcgtactagttcngtcggacgaggag

SEQ ID NO: 402258 - DNA, 658 bp, Homo sapiens
  misc_feature: GZ8MTXP02GN56K.4.37.D04.1.454.CMB.2.raw
  modified_base (364)..(364): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccgcctactatatgcacgtgggtgcgactcggcccctggacgaaggcttggagtggagtggggatggactcgaccctagaggcggtggcacgaaagtntgacacaggtaaagtttcgaaggggcaggggtcaaccgagtacggaaccgacgggggaacctaacccggtacccaacgtaccgaaacgggcctaaacccggttacccaagtacccgaacggaccgaaacccaacggtaccccgttaaacaacgttaccggggaaccccttaggggaaccgggcccgggggtaccccgttaggggaaaccgtaaccgggtaccgtacgtaaaccggtaaccggacgggtaacccgttacgtaacgtttccggtaggtacggtacggacggtacgg

SEQ ID NO: 402259 - DNA, 487 bp, Homo sapiens
  misc_feature: GZ8MTXP02HPXA3.4.37.D04.1.454.CMB.2.raw
  modified_base (312)..(312): a, c, t, g, unknown or other
  modified_base (354)..(354): a, c, t, g, unknown or other
  modified_base (361)..(361): a, c, t, g, unknown or other
  modified_base (461)..(461): a, c, t, g, unknown or other
  modified_base (475)..(475): a, c, t, g, unknown or other
  modified_base (478)..(478): a, c, t, g, unknown or other
  modified_base (482)..(482): a, c, t, g, unknown or other
  modified_base (484)..(484): a, c, t, g, unknown or other
  modified_base (486)..(486): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacagggcttgngtggatgggatggactcgacctaacagcggtggcacaaagtntgaccanaggtaaagtttcgagggcagggtcacgatagacagggacacgtccatcagcacgtccatcagcacacgcctacatcggacctgacgcggcgtggacagcncgactcgcgcgatntcngcgngngng

SEQ ID NO: 402260 - DNA, 499 bp, Homo sapiens
  misc_feature: GZ8MTXP02ILH7M.4.37.D04.1.454.CMB.2.raw
  modified_base (341)..(341): a, c, t, g, unknown or other
  modified_base (359)..(359): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacaagggcttgagtggatgggatggactcgaccctaanagcggtggcacaaagtangacaacgagaagtttcgaggcaggtcacatgacgagggacacgtcatcagcacgtcatcagcacacgcctaacatacggacctgacgcggcgtaggacaagctacgacgacgacggcgtatacttcgagtcgcggaggag

SEQ ID NO: 402261 - DNA, 498 bp, Homo sapiens
  misc_feature: GZ8MTXP02G3LSH.4.37.D04.1.454.CMB.2.raw
  modified_base (357)..(357): a, c, t, g, unknown or other
  modified_base (430)..(430): a, c, t, g, unknown or other
  modified_base (485)..(485): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacagggcttggagtgagtgggatggactcgacctagagcggtgcacgaaagtntgacacgagaagtttcgaggcgaggtcacgatgacgaggacacgtcatcagcacgtcatcagcacgagcctanacgtcggacctgacgcgctgacagtcgacgacgacacggtaacctatacgttcgngtcgcggtaggag

SEQ ID NO: 402262 - DNA, 511 bp, Homo sapiens
  misc_feature: GZ8MTXP02HYEZS.4.37.D04.1.454.CMB.2.raw
  modified_base (252)..(252): a, c, t, g, unknown or other
  modified_base (342)..(342): a, c, t, g, unknown or other
  modified_base (446)..(446): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccgcctactatatgcactgggtgcgactcggcccctggacaagggcttggagtggatgggatggactcgaccctaanaggcggtggcacgaaagtatcgacaacagaagtttcgagggcgagggtacacgatacgaccgagggacacgtccatcagcacgtcatcacgacacacgctacgntacggactgacgcggctggacagtcgacgacgacgacggccgtatacgttcgngtcgacgaggag

SEQ ID NO: 402263 - DNA, 579 bp, Homo sapiens
  misc_feature: GZ8MTXP02IPFH5.4.37.D04.1.454.CMB.2.raw
  modified_base (242)..(242): a, c, t, g, unknown or other
  modified_base (251)..(251): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccagggtgcagctggtgcagtctggggctggaggtgaagaagccgtggggcctgagtgaggtctccngcaggctcnggatacaccttcaccgcctactatatgcacgtgggtgccgacgtcggcccctggacgaagggcttggagtggagtggggatggactccgaacctaagaggcgggtaggacacaaagtatacgacaacgaaggtaaacgtttcgagggacgaagggtaccaaccgagtcggaacccgacggggaaccacgtccataccgagccacgtaccaataccaacgaccaacgacgaccctaacgacgtacggaccgtggaacgccggacctacggactacgtccgacgaccgaaccgacggtaaccgtatacgttcgagtcggacggagggagg

SEQ ID NO: 402264 - DNA, 515 bp, Homo sapiens
  misc_feature: GZ8MTXP02H9DFY.4.37.D04.1.454.CMB.2.raw
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaaggcttctggatacaccttcaccgcctactatatgcacgtgggtgcgactcggcccctggacaagggcttggagtggatggggatggactccgaaccctaagaggcggtggcacaaagtatggacacagaagtttcgagggcgagggtcaccatgacgagggacacgtccatcagcacgtcagtcagacacacgcctacgatacggacctaggacgcggctaggacaagtcacgaccgacgacggcgtatacttcgngtcgacgaggagg

SEQ ID NO: 402265 - DNA, 526 bp, Homo sapiens
  misc_feature: GZ8MTXP02IOOX5.4.37.D04.1.454.CMB.2.raw
  modified_base (225)..(225): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaggtctctgcaaggctctggatacaccttcaccgcctactatatgcacgtgggtgcgactcggcccctggacagggcttggagtggagtgggatggactccgaccctaacgaggcggtggacacgaaagtatgacacgtagaagtttcgagggcgacggggtcaaccagtacgaaccgacggggaccacgtaccagtcagccaccgtccatacagaccacacgacctacacgtcggaacctgacggcggcctggacacgcgtacgacgacgacgcgtatcttcgtgtgacggaggag

SEQ ID NO: 402266 - DNA, 589 bp, Homo sapiens
  misc_feature: GZ8MTXP02IC5GV.4.37.D04.1.454.CMB.2.raw
  modified_base (577)..(577): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccgcctactatatgcagtgggtgcgactcggcccctggacaagggcttggagtggagtgggatggactcgaccctaagaggcggtaggacacgaaaagtatcgacaacgaggtaaagtttcggaagggtcgaaggggtaccaacccgaagtacgaaccgaaggggaaccaaccggtaccaagtacgaacggaccaccggttacctaatacgacggaccaacgaacggaccctaacgacgttacgggaccctaggaacggtccgggacgtacggacaacgtcgacgacgaacgacgaacgtacgtacttcgngtcgacgaggag

SEQ ID NO: 402267 - DNA, 505 bp, Homo sapiens
  misc_feature: GZ8MTXP02ISTV9.4.37.D04.1.454.CMB.2.raw
  modified_base (342)..(342): a, c, t, g, unknown or other
  modified_base (353)..(353): a, c, t, g, unknown or other
  modified_base (360)..(360): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacagggcttgagtggatggggatggactcgacctaacnggcggtgacanaaagtangcacgagtagtttcgagggcgagggtcacgagtagacgacgggacacgtccatcagcacgtcactcagccacacgcctacatcggactgacgcggctaggacacgtcgacgacgacgacggcgtactattcgtgtcgcgaggagg

SEQ ID NO: 402268 - DNA, 510 bp, Homo sapiens
  misc_feature: GZ8MTXP02FP3C9.4.37.D04.1.454.CMB.2.raw
  modified_base (226)..(226): a, c, t, g, unknown or other
  modified_base (249)..(249): a, c, t, g, unknown or other
  modified_base (358)..(358): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaggtctcctgcaggcttcnggatacaccttcaccgcctactatatgcactgggtgcgacgtggcccctggacaagggcttggagtggatggggatggactccgacctaagagcggtgacacgaaagtntgcaagagtaagtttcgaggggcagggtcaccgagtcgaccgagggacacgtcatcagccacgtcatcagcacacgactacagtcgactgacgccggactggacacgcgtacgacgacgacggtaaccgtatagttcgtgtacgcggaggag

SEQ ID NO: 402269 - DNA, 489 bp, Homo sapiens
  misc_feature: GZ8MTXP02FJ45Y.4.37.D04.1.454.CMB.2.raw
  modified_base (335)..(335): a, c, t, g, unknown or other
  modified_base (352)..(352): a, c, t, g, unknown or other
  modified_base (451)..(451): a, c, t, g, unknown or other
  modified_base (475)..(475): a, c, t, g, unknown or other
  modified_base (480)..(480): a, c, t, g, unknown or other
  modified_base (482)..(482): a, c, t, g, unknown or other
  modified_base (484)..(484): a, c, t, g, unknown or other
  modified_base (488)..(488): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggctgagtggatgggatggatcgacctanagcggtggcacaaagtntgcacagaagtttcagggcagggtcaccatgaccagggacacgtcatcagcaggtccatcagacacacgacctacacgtcggacctggacggccgggcngggacaaggcgacgagacgagcgntctcngngngagng

SEQ ID NO: 402270 - DNA, 638 bp, Homo sapiens
  misc_feature: GZ8MTXP02IP7T6.4.37.D04.1.454.CMB.2.raw
  modified_base (238)..(238): a, c, t, g, unknown or other
  modified_base (252)..(252): a, c, t, g, unknown or other
  modified_base (289)..(289): a, c, t, g, unknown or other
  modified_base (340)..(340): a, c, t, g, unknown or other
  modified_base (375)..(375): a, c, t, g, unknown or other
  modified_base (450)..(450): a, c, t, g, unknown or other
  modified_base (502)..(502): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagccagccacacggagcccactcccaggtgcaggctggtgcaggtctggggctgaggtgaagaggcctggggcctgagtgaggtcncctgcaaggcttcnggatacaccttcaccgctactatatgcgactgggtcnccggaccgtggccccctagggacctaaggggacctttgggaggtttagggntaggggattcgggaactacccggacccgttaacgnggccgggtacaggggacctagaaacgtactacgacgtacaggggacgtttacgagggtccaacgggtcgaacccncggtacgaaccgtaccggaacgacgtacgacgtacgaccgacaccgcaaagnttacccaaagccccaaacgacgccggtaaaccgacgtacgggaccgtcggacggacggactcgggccaacggtaccgacgggaccgtagtaacggttaccgtacggtacggttacgacgggttcggacggtggggg

SEQ ID NO: 402271 - DNA, 538 bp, Homo sapiens
  misc_feature: GZ8MTXP02HV75Q.4.37.D04.1.454.CMB.2.raw
  modified_base (225)..(225): a, c, t, g, unknown or other
  modified_base (242)..(242): a, c, t, g, unknown or other
  modified_base (415)..(415): a, c, t, g, unknown or other
  modified_base (537)..(537): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcgtggggcctnagtgagtctctgcaggntctgatacacctcaccgcctactatatgcacgtgggtgcgactcggcccctggacgaagggcttgagtggagtgggatggactccgaccctaagaggcggtggacacgaaagtatgacaacgagaagtttcgagggcgagggtacacgagtacgacgacgggacacgtaccancacgcacgtaccactacagaccaacacgaccctacgacgtacggaccgtaggacggccgggccgtacggacaacggtacgacgaacgacgacgtaaccgtatacgtttcgagtcgacgaggng

SEQ ID NO: 402272 - DNA, 486 bp, Homo sapiens
  misc_feature: GZ8MTXP02HBY2Q.4.37.D04.1.454.CMB.2.raw
  modified_base (338)..(338): a, c, t, g, unknown or other
  modified_base (477)..(477): a, c, t, g, unknown or other
  modified_base (485)..(485): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacagggcttgagtggatgggatggactcgaccctaanagcggtggcacgaaagtatgcacagaagtttcgagggcgagggtcacgatgacgagggacacgtccatcagcacgtcatcagcacagcctacatcgacctgacgcggctgacagtcgcgacacgacgcgtatacttcgngcgcgagng

SEQ ID NO: 402273 - DNA, 485 bp, Homo sapiens
  misc_feature: GZ8MTXP02GB4I7.4.37.D04.1.454.CMB.2.raw
  modified_base (250)..(250): a, c, t, g, unknown or other
  modified_base (337)..(337): a, c, t, g, unknown or other
  modified_base (353)..(353): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcactgggtgcgactggcccctggacaagggcttgagtggatggggatggatcgacctaanagcggtgcacaaagtntgcacagaaagtttcagggcagggtcacatgacagggacacgtcatcagcacgtccatcagcacagcctacatggacctgacgcggactgacatctcgaccgacacggccgtatagtttctgtcgcgaggag

SEQ ID NO: 402274 - DNA, 489 bp, Homo sapiens
  misc_feature: GZ8MTXP02GQ3PD.4.37.D04.1.454.CMB.2.raw
  modified_base (336)..(336): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatggatggatcgacctaanagcggtggcacgaaagtatgacacagaaagtttcgagggcagggtcaccatgaccagggacacgtccatcagcacgtcatcagcacagcctacatggacctgacgcggctggacagctacgacgacgacgccgtatacttctgtgacgaggag

SEQ ID NO: 402275 - DNA, 506 bp, Homo sapiens
  misc_feature: GZ8MTXP02JG2HT.4.37.D04.1.454.CMB.2.raw
  modified_base (341)..(341): a, c, t, g, unknown or other
  modified_base (358)..(358): a, c, t, g, unknown or other
  modified_base (433)..(433): a, c, t, g, unknown or other
  modified_base (487)..(487): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacaagggcttgagtggatgggatggactcgaccctaanagcggtggcacaaagtntgacacagaagtttcgagggcagggtcacatgacgagggacacgtcatcacgcacgtccatcagcacacgcctantggacctgacgcggctaggacagtctgaaccgcaacgggtccgtattacgttcnggtcggacggagggtaagg

SEQ ID NO: 402276 - DNA, 519 bp, Homo sapiens
  misc_feature: GZ8MTXP02IYVKY.4.37.D04.1.454.CMB.2.raw
  modified_base (347)..(347): a, c, t, g, unknown or other
  modified_base (445)..(445): a, c, t, g, unknown or other
  modified_base (506)..(506): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttctggatacaccttcaccgcctactatatgcacgtgggtgcgacgtcggcccctggacaagggcttggagtggagtgggatggactccgaccctaanaggcggtggcacaaagtatgacacgaagtaagtttcgagggcgagggtcacatgacgagggacacgtcatcagcacgtcatcagccacgacgacctanacgtcggacctgacggcggccgtaggacagtcgtacgaccgtacgacggcgtactattcgngtcggcggaggag

SEQ ID NO: 402277 - DNA, 496 bp, Homo sapiens
  misc_feature: GZ8MTXP02GSPXC.4.37.D04.1.454.CMB.2.raw
  modified_base (337)..(337): a, c, t, g, unknown or other
  modified_base (354)..(354): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaataagcctggggcctcagtgaaggtctcctgcaaggcttctggatacaccttcaccgcctactatatgcactgggtgcgactcggcccctggacagggcttgagtggatgggatggactcgacctanagcggtggcacaaagtntgacacagaagtttcgagggcagggtcacatgacagggacacgtcatcagcacgtcatcagcacacgacctacacgtcggacctgacgcggacctggacagtcgacgacgacgacggccgtatacttcgtgtcgcggaggag

SEQ ID NO: 402278 - DNA, 534 bp, Homo sapiens
  misc_feature: GZ8MTXP02FXV8X.4.37.D04.1.454.CMB.2.raw
  modified_base (290)..(290): a, c, t, g, unknown or other
  modified_base (369)..(369): a, c, t, g, unknown or other
  modified_base (524)..(524): a, c, t, g, unknown or other
  modified_base (528)..(528): a, c, t, g, unknown or other
  modified_base (533)..(533): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcaccgcctactatatgcacgtgggngcgactcggcccctggacgaagggcttgaggtggagtgggatggactccgaccctaagacggcggtggacacgaaagtntgacacgaagtaaagtttcgaggggcgagggtacaaccagtcgaaccgaacggggacacgtaccatcgagccacgtccagtcaacgcaaccgacgacctaacacgtcggacctggacgcggcgtgacacgcgacgacgacgacgcgtatgttcgngcgnggagng

SEQ ID NO: 402279 - DNA, 529 bp, Homo sapiens
  misc_feature: GZ8MTXP02ITD6F.4.37.D04.1.454.CMB.2.raw
  modified_base (345)..(345): a, c, t, g, unknown or other
  modified_base (514)..(514): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcaccgcctactatatgcacgtgggtgcgacgtcggcccctggacaagggcttggagtggatgggatggactcgacctaagngcggtggacacgaaagtatgacaagagtaaagtttcgagggcgagggtcaactagtacgacgaagggacacgtacatcacgcacgtacatcacgacacgacgacctacacgtcggacctgacgcggactggacacgtcgacgacgacgacggccgtaattacgttacgngtacggacggaggag

SEQ ID NO: 402280 - DNA, 534 bp, Homo sapiens
  misc_feature: GZ8MTXP02IB1M6.4.37.D04.1.454.CMB.2.raw
  modified_base (254)..(254): a, c, t, g, unknown or other
  modified_base (363)..(363): a, c, t, g, unknown or other
  modified_base (382)..(382): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctgggtgcagtctggggctggaggtgaagaagccgtggggcctcagtgaaggtctcctgcaaggcttcnggatacaccttcacccgtcctactatatgccagtggggtcgcgacctcgggcccccgtgggaacgaaggggtcttggaggtggagtggggatggactccgaccctaagnggcggtggacacgaaagtngacaagagtaaagtttcgacgggcgagggtcacgagtcgaccgaggacacgtccatcagcacgtcatcacgacacacgacctactacttcgaccgtgacgcggctgacacgtcgacgacgacgacggcgtatacttcgtggcgacggaggag

SEQ ID NO: 402281 - DNA, 518 bp, Homo sapiens
  misc_feature: GZ8MTXP02FZE5Z.4.37.D04.1.454.CMB.2.raw
  modified_base (343)..(343): a, c, t, g, unknown or other
  modified_base (358)..(358): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcacccgcctactatatgcactgggtgcgactcggcccctggacaagggcttggagtggagtgggatggactcgaccctaagngcggtgcacaaagtntgacacagtaagtttcgaggggcgagggtcaccgagtacgaccgagggacacgtccatcagcacgtccatcacgcacgacgacctacgactcggacctgacggcggacgtcggacacgtcgacgacgacgacgccgtattacttcgtgtggacggaggag

SEQ ID NO: 402282 - DNA, 532 bp, Homo sapiens
  misc_feature: GZ8MTXP02HJDST.4.37.D04.1.454.CMB.2.raw
  modified_base (369)..(369): a, c, t, g, unknown or other
  modified_base (402)..(402): a, c, t, g, unknown or other
  modified_base (434)..(434): a, c, t, g, unknown or other
  modified_base (520)..(520): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctgagtgaaggtctcctgcaaggcttctggatacaccttcaccgcctactatatgcacgtgggtgcgacgtcggcccctggacaagggcttggagtggagtgggatggactccggaaccctaagaggcggtggacacgaaaagtntgcaacagaagtttccgagggcagggtacacancgacgagggacacgtccatcagcacgtccaancacgacacgacgaccacgacgacgaccgtaggacggccggacgtacggaacgacgtacgacgaacgacgacgtcgtatacgttcgngcgacggaggag

SEQ ID NO: 402283 - DNA, 596 bp, Homo sapiens
  misc_feature: GZ8MTXP02H83M3.4.37.D04.1.454.CMB.2.raw
  modified_base (366)..(366): a, c, t, g, unknown or other
  modified_base (583)..(583): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttctggataccaccttcaccgcctactatatgcacgtgggtgcgactcggcccctggacaagggcttggagtggatgggatggactcgaccctaagaggcggtggacacgaaaagtntggacaacgaggtaaagtttcgaaggggacgaggggtaccaacccgagtacgaaccgaggggaaccaccggtacccagtccgaacggccaaccggtacccaataccgaacggaccaaccgtacggacccttaacgacgttacgggaacccgtaggaacggtccgggaccgtacggaaccaaacggtccgacgaacgaacgacggccgtatacttcgngcgacggacggag

SEQ ID NO: 402284 - DNA, 515 bp, Homo sapiens
  misc_feature: GZ8MTXP02G2HJK.4.37.D04.1.454.CMB.2.raw
  modified_base (368)..(368): a, c, t, g, unknown or other
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgagtgaaggtctcctgcaaggcttctggatacaccttcacccgcctactatatgcacgtgggtgcgactcggcccctggacgaagggcttggagtggagtgggatggactccgacctaagaggcggtggacacgaaagtntgacacgagtagttcgagggcagggtcacgagtcgacgagggaccacgtaccatcgagcacgcatcacgcacacgacctacacgtcggactgacgcggctagacagtcgacgacgacgacgccgtatacttcgngtcgcggaggtag

SEQ ID NO: 402285 - DNA, 500 bp, Homo sapiens
  misc_feature: GZ8MTXP02G7K05.4.37.D04.1.454.CMB.2.raw
  modified_base (284)..(284): a, c, t, g, unknown or other
  modified_base (470)..(470): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccgcctactatatgcactgggtncgactggcccctggacaagggcttgagtggatgggatggatccgaccctaacgagcggtggcaacgaagtatgacacgagtaagtttcgaggggcagggtcacagtcgaccgaggaccacgtcatcagcacgtccatcagcacagcctacagtcggacctgacgtcggctgacacgctcgacgacncggcgtaatattcgtgtcgcgaggtagagg

SEQ ID NO: 402286 - DNA, 643 bp, Homo sapiens
  misc_feature: GZ8MTXP02I2D9Q.4.37.D04.1.454.CMB.2.raw
  modified_base (246)..(246): a, c, t, g, unknown or other
tcagagcactgtagcacgaccggtgctcgatttagtagcatactgttgggtttggggcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtgggctcagtgaggtctctgcaggcttcgnggatacaccttcaccgcctactatatcgcgtaggtggtcgccgtacgtcccggtcccgtaggaacggtaacggtcgttagggtaggtaggtagggtagggtaggtacggtaccgtaaccccccggtaaacccgtaacggacgggtacggggtacgaaaccgaaacgtaaggttagtacggaaaccaacgtaaggtttaacggttacgggacggtacgggtacggtacccgacgtacgaccgaaccgggaacggaccgtaccgtactacgacgacgtaccgtaccgtacaactcgacaccgaacacccgtactacgtacgaccggtacgtacggacggtccccgagtacgacgtacgtcgacgacgacgcgtataactgttgacgaggcgagggagtg

SEQ ID NO: 402287 - DNA, 502 bp, Homo sapiens
  misc_feature: GZ8MTXP02GGUS0.4.37.D04.1.454.CMB.2.raw
  modified_base (340)..(340): a, c, t, g, unknown or other
  modified_base (448)..(448): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgacgtggcccctggacaagggcttgagtggatgggatggatcgaccctaanagcggtggcacaaagtatggacaacgagtaaagtttcgaaggggcaagggtcaccgatcgaccaggacacgtcatcagcacgtccatcagcacagcctacatggaccngacgcgggctggacagtcacgacgacgacgcgtatagttctgtcggcggaggag

SEQ ID NO: 402288 - DNA, 478 bp, Homo sapiens
  misc_feature: GZ8MTXP02GXIIO.4.37.D04.1.454.CMB.2.raw
  modified_base (337)..(337): a, c, t, g, unknown or other
  modified_base (354)..(354): a, c, t, g, unknown or other
  modified_base (455)..(455): a, c, t, g, unknown or other
  modified_base (471)..(471): a, c, t, g, unknown or other
  modified_base (475)..(475): a, c, t, g, unknown or other
  modified_base (477)..(477): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaanagcggtggcacaaagtngcacagaagttcagggcagggtcacatgaccgagggacacgtcatcagcacgtccatcagcacagcctacatggacctgacgcggctgactagcgagacanacggcctatactctgngcgngng

SEQ ID NO: 402289 - DNA, 533 bp, Homo sapiens
  misc_feature: GZ8MTXP02JKQFU.4.37.D04.1.454.CMB.2.raw
  modified_base (225)..(225): a, c, t, g, unknown or other
  modified_base (358)..(358): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaaggtctcctgcaggcttctggatacaccttcaccgcctactatatgcacgtggtgcgtactcggcccctggacaagggcttagagtggatgggatggactcgaccctaagagcggtgacacgaaagtntagacacgagtaaacgtttcgaaggggtcaggggtacaaccgagtacgaaccgagggaccacgtaccatacacgccacgtccatacacgacacacgacctacacgtacggaccctgacgcggtacgacgacgacgtcgacgacgacgacgcgtacttacgtcgtgacgacgagag

SEQ ID NO: 402290 - DNA, 510 bp, Homo sapiens
  misc_feature: GZ8MTXP02H5PNN.4.37.D04.1.454.CMB.2.raw
  modified_base (471)..(471): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggcttctggatacaccttcaccgctactatatgcactgggtgcgactcggcccctggacaagggcttgagtggatggggatgggactccgaacctacgaggcggtaggcacgaaaggtatcgacacaaggaaagttttcgagggcagggtacaccagtgaaccgagggacacgtccatcagcacgtcatcagcacagcctacatcgactgacgcggcctagacacncgtacgacgacgacgccgtatacgttctgtgcgagggag

SEQ ID NO: 402291 - DNA, 565 bp, Homo sapiens
  misc_feature: GZ8MTXP02HM5NJ.4.37.D04.1.454.CMB.2.raw
  modified_base (181)..(181): a, c, t, g, unknown or other
  modified_base (190)..(190): a, c, t, g, unknown or other
  modified_base (281)..(281): a, c, t, g, unknown or other
  modified_base (359)..(359): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtncagctggtncagtctggggctgaggtgaagagctgggctgagtgaggtctctgcaaggctcgtggatacgaccttcaccgcctactatatgcactgggtncgactcggcccctggaccaaggcttggagtggatgggatggactcggaccctaagaggcggtaggaccagaaagttangacaactaggtaaacgtttccgaagggacagggtaccaaccgagtacgaaccgaacgggaacacgtacccagtcgaacgtcgaacgttccaagtcaacggaccaacgacgacctaacgacgtacggaacctggaacggtcggaccgtagacgacgttacgacgacgtaccgacggtaaccgtatagttccgagtacgacgacggag

SEQ ID NO: 402292 - DNA, 576 bp, Homo sapiens
  misc_feature: GZ8MTXP02JFGM8.4.37.D04.1.454.CMB.2.raw
  modified_base (290)..(290): a, c, t, g, unknown or other
  modified_base (377)..(377): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctccgtgcaaggcttctggatacaccttcaccgcctactatatcgcacgtgggtncgactcggccccctgggacaaggggtctttaggaggttggatggggatggactccgacctaacgaggtcggtggacacgtaaaagtntacgacaacaaggtaacgtttcgaagggtcgagggtacaaccgagtacgaaccgacgggacacgtaccatcgagcacgtccatcagaccacgtacgacctacagtacggacctagacggtccggaccgtacggacctacgtaccgtacgaaccgacgaccggtccgttaatacgtttcgtaggtcgacggtagggacgg

SEQ ID NO: 402293 - DNA, 505 bp, Homo sapiens
  misc_feature: GZ8MTXP02IH3DS.4.37.D04.1.454.CMB.2.raw
  modified_base (222)..(222): a, c, t, g, unknown or other
  modified_base (331)..(331): a, c, t, g, unknown or other
  modified_base (425)..(425): a, c, t, g, unknown or other
  modified_base (504)..(504): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggctnagtgaggtctctgcaaggctctggatacaccttcaccgcctactatatgcacgtgggtgcgactcggcccctggacaaggcttgagtgagtggatggatcgaccctaanagcggtggacacaaagtatgacacagtaaagttcgagggtcaggtacacatacgacgagggacacgtcatcagcagtcagtcagcacagcctanacgtcggaacctgacgcgggctaggacctagctacgaacgtacgaccggaacgtaattacgttcgtagtcggacgaggng

SEQ ID NO: 402294 - DNA, 504 bp, Homo sapiens
  misc_feature: GZ8MTXP02GZDZV.4.37.D04.1.454.CMB.2.raw
  modified_base (358)..(358): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacagggcttgagtggatgggatggactcgacctaacgagcggtgacacaaagtntgacacaaggagtttcgagggcagggtcacgatcgacgaggacacgtcatcagcacgtcatcagcacgacgacctaacactcggacctgacggccggactggacgagtcgacgacgacgacggcgtatacgttcagtgcgaggagg

SEQ ID NO: 402295 - DNA, 592 bp, Homo sapiens
  misc_feature: GZ8MTXP02FLHZ2.4.37.D04.1.454.CMB.2.raw
  modified_base (238)..(238): a, c, t, g, unknown or other
  modified_base (246)..(246): a, c, t, g, unknown or other
  modified_base (369)..(369): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggacgcccactcccaggtgcagcgtggtgcagtcgtggggctggaggtgaagagccgtgggctgagtgagtctcngcagtctngactacacctcaccgctactatatgcacgtgggtcgcggtacgtcggccccgtaggacgaagggtcgtggaggtggagtgggatggacctaccgaaccgtagacggcggtagacacgaaagtntgacagaagtaacgttcgagggacgaggtaccaacgtagacgaccgacgggaaccaccgtacacgtacgacgccgaacctccactacgaacgacaaccgacgtaccctaagtacggtacggaaccgtcggaaccggccggtaccgtacgaactacgttaccgacggaaaccgaccgtaccggtccgttaagttacgtttcgaggtacggacgggtaggaacgg

SEQ ID NO: 402296 - DNA, 478 bp, Homo sapiens
  misc_feature: GZ8MTXP02H20MX.4.37.D04.1.454.CMB.2.raw
  modified_base (335)..(335): a, c, t, g, unknown or other
  modified_base (344)..(344): a, c, t, g, unknown or other
  modified_base (352)..(352): a, c, t, g, unknown or other
  modified_base (469)..(469): a, c, t, g, unknown or other
  modified_base (477)..(477): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactcggcccctggacaagggcttgagtgatggatggatcgaccctanagcgtggcncgaaagtntgacacagaagtttcagggcagggtcacgatgacagggacacgtccatcagcacgtcatcagcacagcctacatgacctgacgcggctggacagcgtcgacgacgcggcgtatctcngcgcgagng

SEQ ID NO: 402297 - DNA, 494 bp, Homo sapiens
  misc_feature: GZ8MTXP02JZMON.4.37.D04.1.454.CMB.2.raw
  modified_base (336)..(336): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccgcctactatatgcactgggtgcgactggcccctggacagggcttgagtggatgggatggatccgaccctanagcggtggcacagtatgcacgagaagtttcagggcagggtcacatgacagggacacgtcatagcacgtcatcagcacagcctacagtcggactgacgcggcgtcgacgagcgtacgacgtaccgacgcctataacgttctacgtgcgaggagagtggg

SEQ ID NO: 402298 - DNA, 521 bp, Homo sapiens
  misc_feature: GZ8MTXP02JDTU8.4.37.D04.1.454.CMB.2.raw
  modified_base (250)..(250): a, c, t, g, unknown or other
  modified_base (287)..(287): a, c, t, g, unknown or other
  modified_base (337)..(337): a, c, t, g, unknown or other
  modified_base (353)..(353): a, c, t, g, unknown or other
  modified_base (384)..(384): a, c, t, g, unknown or other
  modified_base (491)..(491): a, c, t, g, unknown or other
  modified_base (493)..(493): a, c, t, g, unknown or other
  modified_base (495)..(495): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcacccgcctactatatgcactgggtncgactggcccctggacaagggcttgagtggatgggatggactcgacctanagcggtgcacaaagtntgcacagtaaagtttcgaggcgagggtaccnccgagtcgacgaggacacgtcacgtacgagcacacgacctacacgtacggaccgtggacggcggccgtaggacgacgtcgtacgacgacgacggcgtatacgttcgngngngaggagagtaggacgtcgtacgtacg

SEQ ID NO: 402299 - DNA, 491 bp, Homo sapiens
  misc_feature: GZ8MTXP02G2GJF.4.37.D04.1.454.CMB.2.raw
  modified_base (337)..(337): a, c, t, g, unknown or other
  modified_base (354)..(354): a, c, t, g, unknown or other
  modified_base (479)..(479): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaanagcggtggcacaaagtntgcagagaagtttcgaggcagggtcactatgacagggacacgtccatcagcacgtccatcagcacacgcctacatcggacctgagcggcctggaccagtctcgacgacgacggccgtatatttcngtgcggaggaag

SEQ ID NO: 402300 - DNA, 496 bp, Homo sapiens
  misc_feature: GZ8MTXP02I4YGO.4.37.D04.1.454.CMB.2.raw
  modified_base (226)..(226): a, c, t, g, unknown or other
  modified_base (251)..(251): a, c, t, g, unknown or other
  modified_base (287)..(287): a, c, t, g, unknown or other
  modified_base (303)..(303): a, c, t, g, unknown or other
  modified_base (339)..(339): a, c, t, g, unknown or other
  modified_base (355)..(355): a, c, t, g, unknown or other
  modified_base (426)..(426): a, c, t, g, unknown or other
  modified_base (456)..(456): a, c, t, g, unknown or other
  modified_base (484)..(484): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttcnggatacaccttcaccgcctactatatgcactgggtncgactcggccccgganaagggcttggagtggatgggatggactcgaccctanagcggtggcacaagtntggcacagtaagtttcgagggcagggtcaccatcgaccagggacaacgtcaatcagcacgtcatcagcacngcctacatgacctgacgcggctgacactcngacgacacggccgtaatacttcgtcggngacggaggagtg

SEQ ID NO: 402301 - DNA, 492 bp, Homo sapiens
  misc_feature: GZ8MTXP02IR43E.4.37.D04.1.454.CMB.2.raw
  modified_base (338)..(338): a, c, t, g, unknown or other
  modified_base (354)..(354): a, c, t, g, unknown or other
  modified_base (439)..(439): a, c, t, g, unknown or other
  modified_base (456)..(456): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtggtgcgactcggcccctggacaagggcttgagtggatggatggactcgacctaanagcggtgcacaaagtntgcacagaagtttcagggcagggtcaccgatgaccagggacacgtccatcagcacgtccagtcagacacagcctacatcggaccngacgcggctgacagtcncgacacgacgcgtagttatttgngacgaggagtagg

SEQ ID NO: 402302 - DNA, 488 bp, Homo sapiens
  misc_feature: GZ8MTXP02F9N1F.4.37.D04.1.454.CMB.2.raw
  modified_base (337)..(337): a, c, t, g, unknown or other
  modified_base (354)..(354): a, c, t, g, unknown or other
  modified_base (426)..(426): a, c, t, g, unknown or other
  modified_base (453)..(453): a, c, t, g, unknown or other
  modified_base (477)..(477): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaanagcggtggcacaaagtntgacacagaagtttcagggcaggtcaacatgaccagggacacgtcatcagcacgtccatcagcacagcctanagtggacctgacgcggcctgaccatcncgacgacgacggcctagtacttcngtagcgaggag

SEQ ID NO: 402303 - DNA, 505 bp, Homo sapiens
  misc_feature: GZ8MTXP02JS5T8.4.37.D04.1.454.CMB.2.raw
  modified_base (253)..(253): a, c, t, g, unknown or other
  modified_base (344)..(344): a, c, t, g, unknown or other
  modified_base (359)..(359): a, c, t, g, unknown or other
  modified_base (493)..(493): a, c, t, g, unknown or other
  modified_base (504)..(504): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcnggatacaccttcaccgcctactatatgcacgtgggtgcgactcggcccctggaccaagggcttgagtggatgggatggactcgacctaagngcggtgcacaaagtngcagagagttcgagggcagggtcaccagtcgacgagggacacgtccatcagcacgtcatcagcacacgacctacgagtacgaccgtgacggcggcgtagacgacgtcgacgacgacgacggcgtatacgttcgngtcgacgaggng

SEQ ID NO: 402304 - DNA, 645 bp, Homo sapiens
  misc_feature: GZ8MTXP02GO1L8.4.37.D04.1.454.CMB.2.raw
  modified_base (369)..(369): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcgtggatacaccttcaccgcctactatatgcagtgggtgcgacgtcggcccctggacgaagggtcttggaggtggagtgggatggactccgacctaagacggcggtgacacgaaagtntagacgagagtagttcgagggcgaggggtcacgtagtacgaaccgacggggactaccggtaccagtaccgaacggaccctaaccggtaccaacgtaccgaacggacccaaccgaaccggtaccttaaacgacggttaccgggaacccgtacggggaaaccggtacccggggccgttacgggaacccgaaacggttcccggtaacggtaaccggtaaccgacggggtaacccgttaattaccgtttacggtacggtacggtacgggtacgggtacgg

SEQ ID NO: 402305 - DNA, 495 bp, Homo sapiens
  misc_feature: GZ8MTXP02HPRCX.4.37.D04.1.454.CMB.2.raw
  modified_base (339)..(339): a, c, t, g, unknown or other
  modified_base (356)..(356): a, c, t, g, unknown or other
  modified_base (402)..(402): a, c, t, g, unknown or other
  modified_base (485)..(485): a, c, t, g, unknown or other
  modified_base (494)..(494): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacccgcctactatatgcactgggtgcgactcggcccctggacaagggcttgagtggatgggatggactcgacctanagcggtggcacaaagtntgcaagagaagttcgagggcagggtcacatgacagggacacgtcancagcacgtcatcacgacacacgacctacacgtacggacctgacgcggcctggacagtcgacgacgacgacgtcgtatcttcgngcgcgaggng

SEQ ID NO: 402306 - DNA, 507 bp, Homo sapiens
  misc_feature: GZ8MTXP02JBJ8I.4.37.D04.1.454.CMB.2.raw
  modified_base (335)..(335): a, c, t, g, unknown or other
  modified_base (351)..(351): a, c, t, g, unknown or other
  modified_base (399)..(399): a, c, t, g, unknown or other
  modified_base (406)..(406): a, c, t, g, unknown or other
  modified_base (409)..(409): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactggtgcgactggcccctggacaagggcttgagtggatggatggactcgacctanagcgtgcacgaaagtntgacacagaaagtttcaggcaaggtcaccatgacagggacacgtccancagcacncanacagacacacgactacgacgtacgacgtggacggcggtacgtacggaacgtacgaccgacgaacgacgacgaacgtactacgtcgtgtacgacgagag

SEQ ID NO: 402307 - DNA, 547 bp, Homo sapiens
  misc_feature: GZ8MTXP02F9ZU3.4.37.D04.1.454.CMB.2.raw
  modified_base (348)..(348): a, c, t, g, unknown or other
  modified_base (532)..(532): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcagtgaaggtctcctgcaaggcttctggatacaccttcaccgcctactatatgcacgtgggtgcgacgtcggccccgtggacgaagggcttggagtggatgggatggatccgaccctaanaggcggtggacacgaaagtatcgacaacgaagtaagtttcgaggggacgaggggtaccaaccgagtacgaaccgagggacacgtacatcagcacgtccatcagcaacgcgacctaacagtcggaactggacgccggcctaggacaacgttcgacgaacgaccgacggaaccgtatactttcggngtacggacggaggag

SEQ ID NO: 402308 - DNA, 481 bp, Homo sapiens
  misc_feature: GZ8MTXP02FJIO5.4.37.D04.1.454.CMB.2.raw
  modified_base (339)..(339): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggactcgaccctaanagcggtggcacaaagtatgcacagaagtttcagggcagggtcacatgaccagggacacgtcatcagcacgtccatcagcacagcctacatggacctgacgcggctggacagtcgcgacgacgacgcgatctctgngcgngng

SEQ ID NO: 402309 - DNA, 527 bp, Homo sapiens
  misc_feature: GZ8MTXP02G633D.4.37.D04.1.454.CMB.2.raw
  modified_base (246)..(246): a, c, t, g, unknown or other
  modified_base (448)..(448): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagagctgggcctcagtgaggtctcctgcaaggcttcnggatacaccttcaccgcctatatatgcagtggtgcgactcggcccctggacaagggcttggagtggagtgggatggactcgacctacagtcggtggacacgaaagtgtacgacaacaggtaagtttcgagggcgaaggggtcaaccgagtcgaaccgacggggaccacgtaccacgtcgaacgtcacgtccatacacgccanacgctacagtcggacctgacgcggctgacagtctacgacgtacgacgaaccgtattacgttctaggcgacggaggtagg

SEQ ID NO: 402310 - DNA, 507 bp, Homo sapiens
  misc_feature: GZ8MTXP02H0SZQ.4.37.D04.1.454.CMB.2.raw
  modified_base (223)..(223): a, c, t, g, unknown or other
  modified_base (282)..(282): a, c, t, g, unknown or other
  modified_base (333)..(333): a, c, t, g, unknown or other
  modified_base (351)..(351): a, c, t, g, unknown or other
  modified_base (431)..(431): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctngtgaggtctcctgcaaggcttctggatacaccttcaccgcctactatatgcactgggtncgactggcccctggaccaagggcttgagtggatgggatggatcgaccctanagcggtggcacgaaagtntgcaacagaaagtttcagggcagggtcaccgatgaccaggggacacggtccatcaagcacgtcatcagcacacgacctanactggacctagacgcggactggaccaagcctacgaacgacgaacggccgtataactttcggtagtcgacggaggag

SEQ ID NO: 402311 - DNA, 619 bp, Homo sapiens
  misc_feature: GZ8MTXP02G44YW.4.37.D04.1.454.CMB.2.raw
  modified_base (251)..(251): a, c, t, g, unknown or other
  modified_base (350)..(350): a, c, t, g, unknown or other
  modified_base (366)..(366): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagcctggggcctcagtgaaggtctcctgcaaggcttcnggatacaccttcaccgcctactatatgcacgtgggtgcgacgtcggcccctggacgaagggcttgaggtggagtggggatggatccccgaaccctacgngcggtgacaacaagtntacggcacgtaagtaacggtttcgaaggggcgaaggggtccaacccgagtacggaacccgaagggaccctaccggtaccaagtaccgaacggaccctaccggttacccaactaccgaaggacccaaaccgaccgacccttaacgacgtacgggaccctgggaacggcccggggacctaggacctaaacgtccgacggaaaccgaccgacgggtaccgtaaacttgttcctacgggtcgacggtacggagtagg

SEQ ID NO: 402312 - DNA, 510 bp, Homo sapiens
  misc_feature: GZ8MTXP02JAJQK.4.37.D04.1.454.CMB.2.raw
  modified_base (251)..(251): a, c, t, g, unknown or other
  modified_base (338)..(338): a, c, t, g, unknown or other
  modified_base (496)..(496): a, c, t, g, unknown or other
  modified_base (509)..(509): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcactgggtgcgacgtggcccctggacaagggcttgagtggatgggatggatcgacctaanagcggtgcacaaagtatgcacagaagtttcgagggcagggtcacagtgaccgaggacacgtcatcagcacgtccatcagcacacgcctacagtcggacctggacgcgggacctaggacgaacgtcgtacgaccgacgacgtaaccgtatacgtttcgngtacggcggaggng

SEQ ID NO: 402313 - DNA, 569 bp, Homo sapiens
  misc_feature: GZ8MTXP02HTRAN.4.37.D04.1.454.CMB.2.raw
  modified_base (226)..(226): a, c, t, g, unknown or other
  modified_base (246)..(246): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctnagtgaggtctctgcagctcngatacactcaccgcctactatatgcacgtgggtgcgactcggcccctggacgaagggcttggagtggagtggggatggactaccgaacccgtacgacggcggtcggacacgaaagtagtgacaacgaggtaaagtttcgagggtacgaggtcaccgatacggaccgacgggacaccgtaccactacgacgccgaccgtacctagtacacgaccaaccgacgacctaacacgtacggaccgtgacggccggaccgtgacgacgttacgacgaccgaacgtaccggtaaccgtagttacgtttcgtagttcggacggagggtagg

SEQ ID NO: 402314 - DNA, 493 bp, Homo sapiens
  misc_feature: GZ8MTXP02FZ36D.4.37.D04.1.454.CMB.2.raw
  modified_base (245)..(245): a, c, t, g, unknown or other
  modified_base (348)..(348): a, c, t, g, unknown or other
  modified_base (479)..(479): a, c, t, g, unknown or other
  modified_base (492)..(492): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgagtctctgcaggcttcnggatacaccttcaccgcctactatatgcactgggtgcgactcggcccctggacaagggctgagtggatgggatgtatccgaccctacagcggtggcacaagtntgcacagaagtttcgagggcagggtcaccatgacgagggacacgtccagtcagtacacgtccatcagcacacgcctacatcggacctgacgcggcctggacacgtcacgacgacacggccgtaatagttcngtggcggaggagng

SEQ ID NO: 402315 - DNA, 502 bp, Homo sapiens
  misc_feature: GZ8MTXP02FVTL0.4.37.D04.1.454.CMB.2.raw
  modified_base (360)..(360): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaggtctcctgcaaggcttctggatacaccttcaccgcctactatatgcacgtgggtgcgactcggcccctggacaagggcttgagtggatgggatggactccgaccctaagagcggtggcacgaaagtntgacaacgagtaagtttcgagggacgagggtcacgatgaccgagggacacgtccatcagcacgtcatcagcacagcctacagtcgactgacgcggcgtggcatctcgacgacgacgcgtattacgtctgtcgcggtaggagg

SEQ ID NO: 402316 - DNA, 546 bp, Homo sapiens
  misc_feature: GZ8MTXP02JQ3VF.4.37.D04.1.454.CMB.2.raw
  modified_base (367)..(367): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcaccgcctactatatgcacgtgggtgcgacgtcggcccctggacaagggcttggagtggagtggggatggactcgaaccctagaggcggtggacacgaaagtntgacagagtagttcgagggcaggtcagtagtagacgaggacacgtcatcgagcacgaccagtcacgacaacgacgaccacgacgtcggaccgtggaacggccggaccgtcggacgtaaacgtcgtacgaccgaccgacgggccttaaacgttacgttcgtggtcggtacggagggtagg

SEQ ID NO: 402317 - DNA, 567 bp, Homo sapiens
  misc_feature: GZ8MTXP02G9VS0.4.37.D04.1.454.CMB.2.raw
  modified_base (369)..(369): a, c, t, g, unknown or other
  modified_base (460)..(460): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtcgtggggcgtgaggtgaagaagccgtgggcctcagtgaggtctcctgcaaggcttctggataccaccttcacccgcctactatatgcacgtgggtgcgactcggcccctggacgaaggcttggagtggagtggggatggactaccgacctaagaggcggtggacacgaaagtngacacgagtaacgtttcgagggcgacgggtacaccgagtacgaccgacggggacaaccggtaccacgtaccgaacggcctaccgtacctanaccgacgaccaccacgacctacagtcggaccgtggacggccggacgtacgacgtaacgtccgacgaaccgacgacggtaacgtatagtttcggaggcgacggaggag

SEQ ID NO: 402318 - DNA, 498 bp, Homo sapiens
  misc_feature: GZ8MTXP02FOS02.4.37.D04.1.454.CMB.2.raw
  modified_base (493)..(493): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaagagcggtgcacgaaagtatgcacagtaagtttcaggggcagggtcacagtgaccagggacacgtcatcagcacgtccatcagcaacacgacctacatcggaacctggacgcggcctggacaagcgtcgaacgacgacgccgtatattctgtcgcgnggagg

SEQ ID NO: 402319 - DNA, 561 bp, Homo sapiens
  misc_feature: GZ8MTXP02HL88L.4.37.D04.1.454.CMB.2.raw
  modified_base (281)..(281): a, c, t, g, unknown or other
  modified_base (486)..(486): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaccaggagcccacctcccacggtgcagctggtgcagtcgtggggctgaggtgaagaagccgtgggcctcagtgaggtctcctgcaaggcttctggatacaccttcaccgcctactatatncactgggtgcgacgtggccccgtggacgaaggctttgaggtggaagtggggatggactaccgacccgtaacgaggcgggtggacaccgtaaaagtatcgacaacgaggaaagtttcgagggtacgacgggtacaccgatacgacgacgggacgaccgtaccactacgagaccacgtaccactacgacgacacgtacgaccctaanacgacgtaaccgngacggacggcgtgacgacgtacgacgacgacgacgtaacgtatacgtcgtgcggacgaggag

SEQ ID NO: 402320 - DNA, 535 bp, Homo sapiens
  misc_feature: GZ8MTXP02JPV6V.4.37.D04.1.454.CMB.2.raw
  modified_base (223)..(223): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctnagtgaggtctctgcaggctctggatacaccttcaccgcctactatatgcacgtgggtgcgactcggcccctggacgaagggtcttgaggtggatgggatggactccgacctaacgaggcggtcggcacgaaagtatcggacacgagtaaagtttcgagggcgacgggtcacgatacgaacgacggggacacgtcactcgagcacgtaccatcagacacgacgacctacgatcggactggacggtccggctggacacgtcgacgaccgacgacggtaaccgtagttacgttcgtaggtcggacggagggtagg

SEQ ID NO: 402321 - DNA, 480 bp, Homo sapiens
  misc_feature: GZ8MTXP02IP03T.4.37.D04.1.454.CMB.2.raw
  modified_base (232)..(232): a, c, t, g, unknown or other
  modified_base (347)..(347): a, c, t, g, unknown or other
  modified_base (418)..(418): a, c, t, g, unknown or other
  modified_base (449)..(449): a, c, t, g, unknown or other
  modified_base (455)..(455): a, c, t, g, unknown or other
  modified_base (471)..(471): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctcagtgagtcnctgcaaggctctgatacaccttcaccgctactatatgcacgtggtgcgactggcccctggacaagggcttgagtggatgggatggatcgaccctaacaggcgtggcacgaaagtntgacacgaagaagtttcgagggtcagggtcaccgatgacgagggacacgtcatcagcacgtcatcagcacncgaccacatgacctgacgcggctggctagcncgacgngacggctagtacttcngcgcgagng

SEQ ID NO: 402322 - DNA, 574 bp, Homo sapiens
  misc_feature: GZ8MTXP02H0ZJS.4.37.D04.1.454.CMB.2.raw
  modified_base (548)..(548): a, c, t, g, unknown or other
  modified_base (556)..(556): a, c, t, g, unknown or other
  modified_base (573)..(573): a, c, t, g, unknown or other
tcagagcactgtagcacgaccggtgctcgatttagtagcatactgttgggtttgggggagcatcacccagcaaccacatctgtcctctagagaatcccctgagagctcccgttcctcaccatggactggacctggaggatcctcttcttggtggcagcagccacaggagcccacctcccaggtgccagctggtgcagtcgtggggctgaggtgaagagccgtgggcctgagtgaggtctcctgcaaggcttcgtggactaccaccttcaccgcctactatatgcacgtggtgcgacgtcggcccctggacgagggcttgagtggagtggggatggtactaccgacctagacggtcgtacggacacgtaaagtatacgaccaagtaggtaaacgttacggacgggacgtacggtcaaccgtaacgacggaaccgacggggaactaacccggtaccacgtacgaacggtacccacgtaccacgtaccacgaccaacgacgacctacgacgtacgtacgcgacggtcggctaggacacgtacgacgaaccngacgcgtnttacgtcgagcgcgagng

SEQ ID NO: 402323 - DNA, 512 bp, Homo sapiens
  misc_feature: GZ8MTXP02FLWBL.4.37.D04.1.454.CMB.2.raw
  modified_base (251)..(251): a, c, t, g, unknown or other
  modified_base (365)..(365): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcacgtggtgcgactcggcccctggacaagggcttggagtggagtggggatggactccgaaccctaagaggcggtggacacgaaagtntgacaacagtaagtttcgaggggcaagggtcaacgatcgacgagggacacgtccatcagcacgtcatacagacacacgacctacagtcgactgacgcgctgacatcacgacgacgacggccgttatacttcgagtcgacggtaggag

SEQ ID NO: 402324 - DNA, 489 bp, Homo sapiens
  misc_feature: GZ8MTXP02JG7QX.4.37.D04.1.454.CMB.2.raw
  modified_base (335)..(335): a, c, t, g, unknown or other
  modified_base (352)..(352): a, c, t, g, unknown or other
  modified_base (426)..(426): a, c, t, g, unknown or other
  modified_base (477)..(477): a, c, t, g, unknown or other
  modified_base (488)..(488): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctcagtgaggtctcctgcaaggcttctggatacaccttcacccgcctactatatgcactgggtgcgactggcccctggacaagggcttgagtgatggatggactcgacctanagcggtgcacgaaagtntgacacgagtaagttcgagggcagggtcacgatgacagggacacgtcatcagcacgcagtcagcacgagcctanatcggacctgacgcggctgacagtcgcgacgacgacgccgtatacgttcgngtcgacggagng

SEQ ID NO: 402325 - DNA, 555 bp, Homo sapiens
  misc_feature: GZ8MTXP02GGIQP.4.37.D04.1.454.CMB.2.raw
  modified_base (253)..(253): a, c, t, g, unknown or other
  modified_base (342)..(342): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcgagtgaaggtctcctgcaaggcttcnggatacaccttcaccgctactatatgcactgggtgcgactcggcccctggacaagggcttggagtggatgggatggactccgacctaancggcggtggacacgaaagtatgacaacaggtaacgtttcgaaggggcgaggggtaccaacgagtacgaaccgaggggacaaccggtccatacgaagaccaacggtccataccacgaccaacgacgacctacgacgttcggaccgtggacgcggtccgtagaccgtagtccgacgaccgacgaccggaacgtatacttcgagtacgcggaggag

SEQ ID NO: 402326 - DNA, 534 bp, Homo sapiens
  misc_feature: GZ8MTXP02H09JU.4.37.D04.1.454.CMB.2.raw
  modified_base (248)..(248): a, c, t, g, unknown or other
  modified_base (254)..(254): a, c, t, g, unknown or other
  modified_base (361)..(361): a, c, t, g, unknown or other
  modified_base (435)..(435): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtgggcctcgagtgaggtctctgcaggctngatacnccttcaccgcctactatatgcacgtggtgcgacgtcggcccctggacgaagggcttggagtggagtgggatggactccgaaccctagaggcggtgacacgtaaagtntgacaacgagtaaacgtttcgaggggacgacgggtcaccgatacgaaccgagggacacgtcatcagcacgtcancagcacgacgcctacagtcgacctggacgcggcctagacacgtcgtacgacgaccgacggtccgttaagttactttcgtcggtacggtacggagggagg

SEQ ID NO: 402327 - DNA, 519 bp, Homo sapiens
  misc_feature: GZ8MTXP02IWG4R.4.37.D04.1.454.CMB.2.raw
  modified_base (288)..(288): a, c, t, g, unknown or other
  modified_base (509)..(509): a, c, t, g, unknown or other
  modified_base (518)..(518): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctgagtgaggtctctgcaggctctggatacaccttcaccgcctactatatcgcacgtgggtcncgacgtcggcccctggacgaagggtctggagtggatgggatggactccgacctagaggcggtcggacacgtaaagtatgacacgaagtaagtttcgagggtcgaggtacacgagtacgacgacgggacacgtaccatacacgcacgtcatcagccacacgactacgagtacgaccgtgacggcggcgtgacgagtcgacgacgacgacgcgtatagttcgngcgacgagng

SEQ ID NO: 402328 - DNA, 485 bp, Homo sapiens
  misc_feature: GZ8MTXP02JD7GM.4.37.D04.1.454.CMB.2.raw
  modified_base (356)..(356): a, c, t, g, unknown or other
  modified_base (385)..(385): a, c, t, g, unknown or other
  modified_base (476)..(476): a, c, t, g, unknown or other
  modified_base (484)..(484): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcaccgcctactatatgcactgggtgcgactggcccctggacaagggcttggagtggatgggatggactcgacctaacagcggtggcacgaaaagtntgcacgagaagtttcagggcaggtcacangacagggacacgtccatcagcacgtcatcagcacacgcctacatcggacctgacgcggctggacagtcgacgacgagacgcgtatcttcgngcgcgagng

SEQ ID NO: 402329 - DNA, 504 bp, Homo sapiens
  misc_feature: GZ8MTXP02FK28T.4.37.D04.1.454.CMB.2.raw
  modified_base (343)..(343): a, c, t, g, unknown or other
  modified_base (492)..(492): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactggcccctggacaagggcttggagtggatggggatggactcgaccctaaanagcggtggcacaaagtatgcacaagaagtttcgaggggcgagggtcaccatgaccgagggacacgtccatcagcacgtccatcagcacagcctacatggacctgagcgggcctggaccagtcgcgacgacgacggaaccgtatagttcngtcgcgaggagg

SEQ ID NO: 402330 - DNA, 493 bp, Homo sapiens
  misc_feature: GZ8MTXP02IHBFL.4.37.D04.1.454.CMB.2.raw
  modified_base (222)..(222): a, c, t, g, unknown or other
  modified_base (231)..(231): a, c, t, g, unknown or other
  modified_base (238)..(238): a, c, t, g, unknown or other
  modified_base (241)..(241): a, c, t, g, unknown or other
  modified_base (274)..(274): a, c, t, g, unknown or other
  modified_base (304)..(304): a, c, t, g, unknown or other
  modified_base (323)..(323): a, c, t, g, unknown or other
  modified_base (483)..(483): a, c, t, g, unknown or other
  modified_base (492)..(492): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggctnagtgagtcnctgcagntcngatacactcaccgctactatatgcacgtgggtncgactcggcccctggacaggcttgagtgangggatggactcgacctaanggcggtgcacgaaagtatgacacgagtaagtttcaggggcagggtacaccgatgaccgagggacacgtaccatcagcacgtccatcagacacgacacctacagtcggacctggaacgccggctaggactacgcgacgaacgtcacggtcgtatacttcgngcgcgaggng

SEQ ID NO: 402331 - DNA, 680 bp, Homo sapiens
  misc_feature: GZ8MTXP02ISK5R.4.37.D04.1.454.CMB.2.raw
  modified_base (393)..(393): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaacgccgtggggcctcgagtgaacggtctccgtgacgaaggtcttcgtaggactacctaccttcaccgtaccctactactagtgcacgtgggtcgcggactcggccccgtaggacgaacgggtcttggaggtcggagtagggtacgtacggacgtccgaacccgtaacgcgggtacngggggactcgaaaactaccggtaaagtcgtaccggaacgacgggttaaacggggtttaccgggggacgtaacgggggtaccaaaccggcgtaaaaccgggaccgaaccggggtacgaaaccggccctaacggtaccaacggaccttaaaccgtccaaaagctacccaacgaccgaacgaacgtaccgtaacgacgtacggaccgtacggacggacggaccgtcggccaacgtaccgtacgtaccgtacgtaacggtaccgtacgtacgttacgtacgtcgacgaggg

SEQ ID NO: 402332 - DNA, 528 bp, Homo sapiens
  misc_feature: GZ8MTXP02HS87O.4.37.D04.1.454.CMB.2.raw
  modified_base (244)..(244): a, c, t, g, unknown or other
  modified_base (280)..(280): a, c, t, g, unknown or other
  modified_base (332)..(332): a, c, t, g, unknown or other
  modified_base (348)..(348): a, c, t, g, unknown or other
  modified_base (399)..(399): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggctcagtgaggtctctgcaaggcttcnggatacaccttcaccgcctactatatgcactgggtncgactggcccctggacaagggcttgagtggatgggatggatcccgacctaanagcggtggcacaagtntgcacagaagtttcgagggcagggtcacgatcgaccgagggacacgtccanacagcacgtccatcacgcaacacgacctacaagtcgggaacccgtggacggccggtaccgtacgactacgtcgtacgaccgaccgaccggtacgttaagttcgttcgtggcggtacggagggtagtagg

SEQ ID NO: 402333 - DNA, 559 bp, Homo sapiens
  misc_feature: GZ8MTXP02I4MO5.4.37.D04.1.454.CMB.2.raw
  modified_base (247)..(247): a, c, t, g, unknown or other
  modified_base (285)..(285): a, c, t, g, unknown or other
  modified_base (371)..(371): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaggtctcctgcaggtctcgnggatacaccttcaccgcctactatatgcacgtgggtcncgacgtcggccccgtggacgaagggcttggagtggagtggggatggactaccccgaccctaagacggtcggtgaccaacgtaagtntacgacacgaagttaagttacgagggcgagggtaccacgagtacgaaccgagggaccacgtccagtcagccacgtccatcacgcaacgacgacctacagtacgaccgtagacggcgtccgtcgacaacgtcctacgaccggtaccgacggtaccgtaattgttaccgtcgtggacggaggacgtaggg

SEQ ID NO: 402334 - DNA, 492 bp, Homo sapiens
  misc_feature: GZ8MTXP02I9HL7.4.37.D04.1.454.CMB.2.raw
  modified_base (222)..(222): a, c, t, g, unknown or other
  modified_base (247)..(247): a, c, t, g, unknown or other
  modified_base (283)..(283): a, c, t, g, unknown or other
  modified_base (332)..(332): a, c, t, g, unknown or other
  modified_base (349)..(349): a, c, t, g, unknown or other
  modified_base (425)..(425): a, c, t, g, unknown or other
  modified_base (427)..(427): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctgggctnagtgaaggtctcctgcaaggcttcnggatacaccttcaccgcctactatatgcactgggtncgactggcccctggacaagggcttgagtggatgggatggatcgacctanagcggtgcacgaaagtntgcacagtaagtttcgagggcagggtcaccgatgacgagggacacgtccatcagcacgtcagtcagcacagcctanancggacctgacgtcggctagacatctcgaccgacgacggccgtagtacttcgtgtcgcgtagggag

SEQ ID NO: 402335 - DNA, 559 bp, Homo sapiens
  misc_feature: GZ8MTXP02HTGBO.4.37.D04.1.454.CMB.2.raw
  modified_base (290)..(290): a, c, t, g, unknown or other
  modified_base (543)..(543): a, c, t, g, unknown or other
  modified_base (555)..(555): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccgggtgcagctggtgcagtctggggctgaggtgaagaagcctggggcctcgagtgaaggtctcctgcaaggcttctggatacaccttcaccgcctactatatcgcacgtgggtncgactcggcccctggacaagggcttgagtggagtgggatggatcccgacctaacgagcggtggccaacgaagtatgacacgagaacgtttcgagggtcagggtaccacagtcgaaccgagggaccacgtccatacgacgaccaccgtaccactacgagaccacgacgaccctacgagtacggaacctgggacgccgggtctacggactacgtctacgaccgacaccgggtaccttaagttactttcgtacggngacggagggtanaggg

SEQ ID NO: 402336 - DNA, 495 bp, Homo sapiens
  misc_feature: GZ8MTXP02F9HHB.4.37.D04.1.454.CMB.2.raw
  modified_base (251)..(251): a, c, t, g, unknown or other
  modified_base (287)..(287): a, c, t, g, unknown or other
  modified_base (338)..(338): a, c, t, g, unknown or other
  modified_base (354)..(354): a, c, t, g, unknown or other
  modified_base (483)..(483): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcactgggtncgactggcccctggacaagggcttgagtggatgggatggatcgaccctaanagcggtgcacaaagtntgacacaagtaagtttcgagggcagggtcaccagtcgaccgagggacacgtcatcagcacgtccatcagcacacgcctacatggactgacgcggctggacagtctagacgactacggcgtatacgttcngtcgcgagggag

SEQ ID NO: 402337 - DNA, 509 bp, Homo sapiens
  misc_feature: GZ8MTXP02IYKF0.4.37.D04.1.454.CMB.2.raw
  modified_base (227)..(227): a, c, t, g, unknown or other
  modified_base (496)..(496): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaaggtctcctgcaaggcttctggatacaccttcaccgcctactatatgcacgtggtgcgactcggcccctggacaggctgagtggatggatggactcgaccctaagagcggtggcacgaaagtatagacaacgagtaagtttcgaggggcaggggtcaacagtcgaaccgagggacacgtacatcagcacgtcatcagacacagacctacgatggacctgacgccggctcggacaagtctacgaacgacgacgccgtatattcgngtcggacgaggag

SEQ ID NO: 402338 - DNA, 549 bp, Homo sapiens
  misc_feature: GZ8MTXP02F8WWE.4.37.D04.1.454.CMB.2.raw
  modified_base (252)..(252): a, c, t, g, unknown or other
  modified_base (348)..(348): a, c, t, g, unknown or other
  modified_base (367)..(367): a, c, t, g, unknown or other
  modified_base (531)..(531): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccgcctactatatgcacgtgggtcgcgacgtcggcccctggacgaagggtcttgagtggatgggatggactccgaccctaagnggcggtggacacgaaagtntgcacagtaagttcgaggggcagggtcaacgagtacgaccgacggggacacgtccagtcacgccacgtccatcagaccaacgacgcctaacgagtcgggaacctggaacgccgggcctaggaccagtccgacgaaccgaccgacggtccgttattacgtttcgnggtacgacggaggtaagg

SEQ ID NO: 402339 - DNA, 480 bp, Homo sapiens
  misc_feature: GZ8MTXP02FQR7N.4.37.D04.1.454.CMB.2.raw
  modified_base (334)..(334): a, c, t, g, unknown or other
  modified_base (342)..(342): a, c, t, g, unknown or other
  modified_base (446)..(446): a, c, t, g, unknown or other
  modified_base (453)..(453): a, c, t, g, unknown or other
  modified_base (468)..(468): a, c, t, g, unknown or other
  modified_base (476)..(476): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactggtgcgactggcccctggacaagggcttgagtggatgggatggatcgacctanagcgtgcncaaagtatgcacagaagtttcagggcagggtcaccatgacagggacacgtcatcagcagtccatcagcacagcctacatggacctgacgcggcctggaccatcncgacganacggcgtatattcgngtcgacgnggag

SEQ ID NO: 402340 - DNA, 535 bp, Homo sapiens
  misc_feature: GZ8MTXP02GETXP.4.37.D04.1.454.CMB.2.raw
  modified_base (228)..(228): a, c, t, g, unknown or other
  modified_base (364)..(364): a, c, t, g, unknown or other
  modified_base (427)..(427): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctnagtgaaggtctcctgcaaggcttctggatacaccttcaccgcctactatatgcacgtgggtgcgactcggcccctggacaagggcttgaggtggatgggatggactcgaccctaagaggcggtggacacgaaagtntgacaacagtaagtttcgagggcgaggtcacagtacgacgaggacacgtcatcagcacgtcancacgacacacgacctacgacgtcggaccgtagacggaccggtccgacggacgacgtccgtacgaaccgacgacggtaaccgttatacgttgcggtacgacggaggaag

SEQ ID NO: 402341 - DNA, 543 bp, Homo sapiens
  misc_feature: GZ8MTXP02HPZGU.4.37.D04.1.454.CMB.2.raw
  modified_base (341)..(341): a, c, t, g, unknown or other
  modified_base (415)..(415): a, c, t, g, unknown or other
  modified_base (432)..(432): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacccgcctactatatgcactgggtgcgactcggcccctggacaagggcttggagtggatgggatggactcgaccctanaggcggtgcacaaagtatgacacagaaagtttcgaggcgagggtacaaccagacgaccgagggaactacgccanacgacgaccacgtacanacacgaccacgacgtacctaacgacgacggacgtagacgccggactacgactacgtacgtacgaaccgaacgacgtaaccgttattacgttcgtacgtcggacggaggagg

SEQ ID NO: 402342 - DNA, 598 bp, Homo sapiens
  misc_feature: GZ8MTXP02GFA6L.4.37.D04.1.454.CMB.2.raw
  modified_base (257)..(257): a, c, t, g, unknown or other
  modified_base (576)..(576): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgagtgaaggtctccgtgcaaggtcttcgnggatacaccttcaccgctactatatgcacgtgggtcgcgacgtcggccccgtggacgagggtcttaggaggtggagtgggagtggactccgacctaacgcggcggtgacacgaaagtgtagacaagtaggtaacgggtttcggggacgtacggggtaccaccgagtcggaaacccggacggggaacctaccggtaccgacgtaccgaacggaccgaaccggtaccacgtaccacggaccaacgaccgtaccctacgaagtcggaaccgtggacggccggcgtacggacacgtaccgagacgacgaccggacttaacgtnttcgacggtgacggaggagtgg

SEQ ID NO: 402343 - DNA, 500 bp, Homo sapiens
  misc_feature: GZ8MTXP02GCKYQ.4.37.D04.1.454.CMB.2.raw
  modified_base (285)..(285): a, c, t, g, unknown or other
  modified_base (335)..(335): a, c, t, g, unknown or other
  modified_base (348)..(348): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtncgactggcccctggacaagggcttgagtggatgggatggatccgacctangcggtgcacagtngcacagaagtttcgagggcagggtcacatgacgagggacacgtccattacgcacgtccatcagcacacgacctacatcggacctgacgcggctacggacagtcgacgacgacgacggcctataacgttcgtagtcgaggtaggagagtaggg

SEQ ID NO: 402344 - DNA, 506 bp, Homo sapiens
  misc_feature: GZ8MTXP02F025S.4.37.D04.1.454.CMB.2.raw
  modified_base (237)..(237): a, c, t, g, unknown or other
  modified_base (249)..(249): a, c, t, g, unknown or other
  modified_base (356)..(356): a, c, t, g, unknown or other
  modified_base (435)..(435): a, c, t, g, unknown or other
  modified_base (475)..(475): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtcncctgcagcttcnggatacaccttcaccgcctactatatgcacgtgggtgcgactcggcccctggacagggcttgagtggagtgggatggactcccgaccctacgagcggtgacacagtngcacagtagttcgagggacagggtcacagtgaccgagggaccacgtaccagtacagcacgtcatcagcaacacgcctancgtgccagcgcggctagacacgtcacgacgacgaccggtntaactacgttcgagtcggacggaggagtagg

SEQ ID NO: 402345 - DNA, 521 bp, Homo sapiens
  misc_feature: GZ8MTXP02HGQB1.4.37.D04.1.454.CMB.2.raw
  modified_base (451)..(451): a, c, t, g, unknown or other
  modified_base (472)..(472): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacaagggcttgagtggatggggatggactcgaccctaagagcggtggcacgaaagtatgacacaggaagtttcgaggggcaggggtcacgatacgaccgtaggggacacggtcccatccagcaaccgtccaatcacgcacacgcctanatggacctgacgcggctgacntcgtacgaccgacgacggtcgtaattacttcgtgtcgacggagggtagg

SEQ ID NO: 402346 - DNA, 747 bp, Homo sapiens
  misc_feature: GZ8MTXP02J2GI5.4.37.D04.1.454.CMB.2.raw
  modified_base (254)..(254): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagcgtggtgcagtcgtggggctgaggtagaagaacgccgtgggcctcgagtgagtctctgcaggcttcgnggactaccaccttccaccgtcctaactatagtcgactacggttgggtcgcgtaccgtcggcccccgtagggaacgtaacggggtcttggaggtagggagtaggggagtacgggtacctaccgaccctaacggaggtcggaggaccaacggaaaagttcgtacgaacaaccgtaacggttaaagtttccgggaaaggggaccggttaacggggtacccaaacccgtaaaggtacccgaaacccgggtaacggggtaaacccaacccggttaaccccgtaaacgtacccgaacgtacccgtaacccggtacaccgtaaccgaaccgaccgaaaccgtacccggtaacccgtaacgtaccggtaccgggtaaccgtacgggaccggtacccggtaaccgtaacgaaccgtaaccgtaccggtaacgaaacccggtaaccggtaccggtaaccgtttacgttacgttcggtaggtacggtacgggtacgggtaacgg

SEQ ID NO: 402347 - DNA, 535 bp, Homo sapiens
  misc_feature: GZ8MTXP02IVOKY.4.37.D04.1.454.CMB.2.raw
  modified_base (227)..(227): a, c, t, g, unknown or other
  modified_base (453)..(453): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaaggtctcctgcaaggcttctggatacaccttcaccgcctactatatgcacgtgggtcgcgactggcccctggacaagggcttgagtggatgggatggactacgacctacgagcggtaggtaacagtatgacacgagtaagtttcagggcagggtcacagtgaccgaggtaccacgtaccatacagtaccacgtaccactcaagccaacgacgtacccctanacgtacggacctacggacgccgggtccagggacaacgtcgtacgacgacgacggactaacgtattacgcgtagcgacgagag

SEQ ID NO: 402348 - DNA, 502 bp, Homo sapiens
  misc_feature: GZ8MTXP02FH6EP.4.37.D04.1.454.CMB.2.raw
  modified_base (338)..(338): a, c, t, g, unknown or other
  modified_base (490)..(490): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacaaggctgagtgatgggatggactcgaccctaangcggtgcacgaaagtatgcacagtaaacgtttcgaaggggcgagggtcacgatgacccgagggacacgtcatcagcacgtccatcagcacagcctacatgacctgacgcggctaggacacgtctacgacgacgacggccgtaatatttccgngcgacggaggag

SEQ ID NO: 402349 - DNA, 620 bp, Homo sapiens
  misc_feature: GZ8MTXP02G8IK6.4.37.D04.1.454.CMB.2.raw
  modified_base (255)..(255): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcgtggggcctcgagtgaaggtctccgtgcaaggcttcgnggactaccaccttccaccgcctactatatgcagtgggtgcgactcggcccctggacgagggcttggagtggagtgggatggactcgaccctaagcggcggtacgacacgaaagtgtacgagaagaagtaacgttcggaaggggtcgagggtacaacgtagtacggaaccgtacggggactaccggtaccacgtacgaacgccgtaaccggtaccctaacgtacccaacggaccaaaccgtaccggacccttaacgacgttaccgggaccgtaggaccggtaccggaccgtaggacctacgtccgacgaccgaacgtaccggtaaccgttattacgtttacgtggtacggacgggtagggtaacgg

SEQ ID NO: 402350 - DNA, 553 bp, Homo sapiens
  misc_feature: GZ8MTXP02JSSH5.4.37.D04.1.454.CMB.2.raw
  modified_base (253)..(253): a, c, t, g, unknown or other
  modified_base (358)..(358): a, c, t, g, unknown or other
  modified_base (376)..(376): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggagcctcagtgaaggtctcctgcaaggcttcgnggataccaccttcacccgcctactatatcgcacgtggggtcgccgacgtcggcccctgggacaaggggtcttggagtggagtggggatggactccgaccctaagnggcggtgcaacgaaagtngcaacgagtacgttcgagggcgagggtcacgagtcgaccgagggaccacgtccatcacgcacgtaccatcgacgacacgacgccctaacacgtacggaccgtggaccggccggccgtacggacgtaacgtcgacgaccgacgaaccggtcgtaagttcttcgcggtcgacggtaggg

SEQ ID NO: 402351 - DNA, 535 bp, Homo sapiens
  misc_feature: GZ8MTXP02HCCDS.4.37.D04.1.454.CMB.2.raw
  modified_base (252)..(252): a, c, t, g, unknown or other
  modified_base (317)..(317): a, c, t, g, unknown or other
  modified_base (361)..(361): a, c, t, g, unknown or other
  modified_base (457)..(457): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggctcnggatacaccttcaccgcctactatatgcacgtgggtgcgactcggcccctggacaagggcttggngtggagtgggatggacctcgaccctagagcggtgcacaaagtangacacgagtaagtttcgagggcgacgggtcaccgagtacgaccgacggggacaccgtaccatcacgccacgtccatcgacgacacgacgaccctanactcggacctggacgcggcctagacctagtccgacgaaccgacgaccggtccgtatacgttctacggtgcggagggag

SEQ ID NO: 402352 - DNA, 533 bp, Homo sapiens
  misc_feature: GZ8MTXP02GAZPZ.4.37.D04.1.454.CMB.2.raw
  modified_base (360)..(360): a, c, t, g, unknown or other
  modified_base (424)..(424): a, c, t, g, unknown or other
  modified_base (440)..(440): a, c, t, g, unknown or other
  modified_base (522)..(522): a, c, t, g, unknown or other
  modified_base (532)..(532): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggctggaggtgaagaagccgtggggcctcagtgaaggtctcctgcaaggcttctggatacaccttcaccgcctactatatgcacgtggtgcgactcggcccctggacaaggctgagtggagtggatggactccgacctaagcgcggtgacacgaaagtntgacaacaaggtaacgtttcgagggcgagggtcaaccgagtgaaccgacgggaacacgtccaanacgacgacacgtacanacgacacacgacgaccacgacgtacgacgaggacggcggacgacgacgacgtcgacgacgacgacgtaacgtagtacgtcgngcgacgaggng

SEQ ID NO: 402353 - DNA, 547 bp, Homo sapiens
  misc_feature: GZ8MTXP02IYYH3.4.37.D04.1.454.CMB.2.raw
  modified_base (467)..(467): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctgggcctcagtgaggtctctgcaggcttctggatacaccttcaccgctactatatgcacgtgggtgcgactcggcccctggacgaaggcttggagtggagtgggatggactccgaccctaagacggcggtacggacacgaaagtatcgaccaacgagtaagtttccgaggggtcgaggggtaccaacgagtacgaaccgaggggaccacgtaccagtcacgcaccgtccatccgagaccacacgcctanaacgtcggacctgacggtcgctaggactagtcgtacgaccgacgacggtccgttattacttcgagtcggacggaggaagg

SEQ ID NO: 402354 - DNA, 520 bp, Homo sapiens
  misc_feature: GZ8MTXP02F5EYA.4.37.D04.1.454.CMB.2.raw
  modified_base (224)..(224): a, c, t, g, unknown or other
  modified_base (247)..(247): a, c, t, g, unknown or other
  modified_base (500)..(500): a, c, t, g, unknown or other
  modified_base (519)..(519): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctgggcctnagtgaggtctctgcaaggcttcnggatacaccttcaccgcctactatatgcacgtgggtgccgactcggccccctggaccaagggtcttggaggttggagtggggatggactccgaccctaagaggcggtggacacgaaagtatgacacgaagtaacgtttcgagggtcgaggtcaacgagtacgaccgagggacaacggtccagtcacgcaccgtcatcagacacacgacctacatcggactgacgcggctgacagtctacgacgacgacgcgtntacgttctggcgacgaggng

SEQ ID NO: 402355 - DNA, 552 bp, Homo sapiens
  misc_feature: GZ8MTXP02J1XGK.4.37.D04.1.454.CMB.2.raw
  modified_base (258)..(258): a, c, t, g, unknown or other
  modified_base (381)..(381): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcgagtgaaggtctccgtgcaaggtcttcgnggataccaccttcaccgtcctactatatgcacgtgggtgcgacgtcggccccgtaggacgaagggtctggaggtggagtgggatggactaccgaccctaagacggtcggtggacacgaaagtntcgacacgaagtaaggttcgaggggtcgacgggtccaccgtagacgaccgaggacacgtacacgtcacgaccaccgtaccatacacgacacaccgtacctacagtcgaactggacggcgggcaggactacgcgacgacgacgacgtccgtatagtcgtgtcgacggaggag

SEQ ID NO: 402356 - DNA, 527 bp, Homo sapiens
  misc_feature: GZ8MTXP02JU6EU.4.37.D04.1.454.CMB.2.raw
  modified_base (253)..(253): a, c, t, g, unknown or other
  modified_base (353)..(353): a, c, t, g, unknown or other
  modified_base (372)..(372): a, c, t, g, unknown or other
  modified_base (447)..(447): a, c, t, g, unknown or other
  modified_base (490)..(490): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaggcttcnggatacaccttcaccgcctactatatgcacgtgggtgcgacgtcggcccctaggaccaaggggtcttggaggtggagtggggatggactccgacctaagnggcggtggacacgaaagtntcgacaacgaggtaagtttcgaggggacgagggtacacgagtcgaccgagggacacgtccatcgacgcacgctancacgacacacgcctacacgtcggactgacggcggacgcggacngtcgacgacgacgacgcgtagtatcgtgcgcgaggag

SEQ ID NO: 402357 - DNA, 581 bp, Homo sapiens
  misc_feature: GZ8MTXP02HLQ5X.4.37.D04.1.454.CMB.2.raw
  modified_base (240)..(240): a, c, t, g, unknown or other
  modified_base (360)..(360): a, c, t, g, unknown or other
  modified_base (449)..(449): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactccaggtgcagctggtgcagtcgtggggctgaggtgaagaagccgtggggcctgagtgaaggtctcngcaaggctcgtgatacactcaccgctatatatgcacgtgggtgcgactcggcccctggaacgaagggtcttggagtggatggggatggactccgaaccctagagcggtggacacaaagtntgacaacgagtaaagtttcgagggcgagggtacaaccgagtacgaaccgaaggggaccaacgtacccatacgaggaccacgtacctaanacgacgacaacgacgacctaacgacgtacggaccgtacggacggccggaccgtacgactacgtacgtacgaaccgtaaccgaccggtaaccgttaagttacgtttacgtaggtacggacgggaagggtacgg

SEQ ID NO: 402358 - DNA, 497 bp, Homo sapiens
  misc_feature: GZ8MTXP02FQDL4.4.37.D04.1.454.CMB.2.raw
  modified_base (340)..(340): a, c, t, g, unknown or other
  modified_base (364)..(364): a, c, t, g, unknown or other
  modified_base (486)..(486): a, c, t, g, unknown or other
  modified_base (496)..(496): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgacgtggcccctggacaagggctggagtggatgggatggactcgacctaanaggcggtaggcagaaagtatgcanagaagtttcgaaggggcagggtcaccatgacagggacacgtccatcagcacgtcatcagcacacgcctagagtcgaccgtgacgccggctgacctagtccgagacgagacgcgtatcttcgngtgacgaggng

SEQ ID NO: 402359 - DNA, 504 bp, Homo sapiens
  misc_feature: GZ8MTXP02G5EJB.4.37.D04.1.454.CMB.2.raw
  modified_base (251)..(251): a, c, t, g, unknown or other
  modified_base (339)..(339): a, c, t, g, unknown or other
  modified_base (357)..(357): a, c, t, g, unknown or other
  modified_base (385)..(385): a, c, t, g, unknown or other
  modified_base (491)..(491): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctgagtgaaggtctcctgcaaggcttcnggatacaccttcaccgcctactatatgcacgtgggtgcgactcggcccctggacagggcttggagtggatggatggactcgacctaanggcggtggcacgaaagtngacacagaagttcgaggcagggcacgangaccgagggacacgtcatcagcacgtccatcagccactacgacctacatcggaacctggacggcggccgtaggaccagtccgtagacgtacgacgcgtatattcgngtcgacgaggagg

SEQ ID NO: 402360 - DNA, 585 bp, Homo sapiens
  misc_feature: GZ8MTXP02JR2DL.4.37.D04.1.454.CMB.2.raw
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaggcttctggatacaccttcaccgcctactatatcgcacgtggggtgcgacgtcggcccctggacaagggcttggaggtggagtgggatggatcccgacccgtaagacgcgggtggacaacgaaggtatggacaacgagtaacgtttcgaggggcgaggggtccaaccgagtacggaacccgaagggaccgtaaccgtcccgaagttacgaccgaacccggtaccaacgtcgaacgaccacgaacgtaccctaacagtacggactggaacggccgccgtacggacacgtcgtacgacgacgacggtactagtaacgttcgagtcggacgtaggagagtggg

SEQ ID NO: 402361 - DNA, 480 bp, Homo sapiens
  misc_feature: GZ8MTXP02FGMCZ.4.37.D04.1.454.CMB.2.raw
  modified_base (338)..(338): a, c, t, g, unknown or other
  modified_base (429)..(429): a, c, t, g, unknown or other
  modified_base (452)..(452): a, c, t, g, unknown or other
  modified_base (473)..(473): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaanagcggtggcacaaagtatgcacagaaagtttcagggcagggtcaccatgaccagggacacgtccatcagcacgtccatcagcacagcctanatggacctgagcggctgacagcncgacacacggctatactctgngcgagng

SEQ ID NO: 402362 - DNA, 532 bp, Homo sapiens
  misc_feature: GZ8MTXP02HS70V.4.37.D04.1.454.CMB.2.raw
  modified_base (229)..(229): a, c, t, g, unknown or other
  modified_base (255)..(255): a, c, t, g, unknown or other
  modified_base (378)..(378): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctcctgcaaggcttcgnggataccaccttcacccgcctactatactgctacgtgggtcgcgacgtcggcccctaggacgaagggtcttggaggtggagtgggatggactccgaaccccgtagaggcggtgacacaaagtnagacaagagtaagtttcgagcgaggtcacgagtacgacgaggacacgtcatcagcacgtcatcacgcacgacgactacgacgtacgacgtgacgcggactaggactacgacgtacgacgacgacggcgttatacgttcagtcgacggtaggagg

SEQ ID NO: 402363 - DNA, 523 bp, Homo sapiens
  misc_feature: GZ8MTXP02FOFRM.4.37.D04.1.454.CMB.2.raw
  modified_base (341)..(341): a, c, t, g, unknown or other
  modified_base (445)..(445): a, c, t, g, unknown or other
  modified_base (467)..(467): a, c, t, g, unknown or other
  modified_base (508)..(508): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggataccaccttcacccgctactatatgcacgtgggtgcgactcggcccctggacagggcttgagtggatgggatggactcgacctaangcggtgacacgaaagtatgacacgagtaacgtttcgagggcagggtacacagtacgaccgaggaccacgtccagtcagacacgtccatcagacacacgacctanacgtcggacctgacgcggaccngacacgtacgtacgaccgacgacggtccgtaatacgttcgngtagacggaggtagg

SEQ ID NO: 402364 - DNA, 520 bp, Homo sapiens
  misc_feature: GZ8MTXP02GYV0O.4.37.D04.1.454.CMB.2.raw
  modified_base (356)..(356): a, c, t, g, unknown or other
  modified_base (436)..(436): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaaggtctcctgcaaggcttctggatacaccttcaccgcctactatatgcactgggtgcgactcggcccctggacaagggcttgagtggatggggatggatccgaccctacgagcggtggcacaagtntgcacagaagtttcgaggggtcaggggtcacagtcgaccgagggacacgtccattagcacgtccatcagcacacgcctanatgacctgagcgcgtcgacagtcgacgacgacgaccgccggttaataagtttccgtaggttacgacggagggagaggttagggg

SEQ ID NO: 402365 - DNA, 517 bp, Homo sapiens
  misc_feature: GZ8MTXP02GZDCC.4.37.D04.1.454.CMB.2.raw
  modified_base (250)..(250): a, c, t, g, unknown or other
  modified_base (340)..(340): a, c, t, g, unknown or other
  modified_base (507)..(508): a, c, t, g, unknown or other
  modified_base (510)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagctggggcctcagtgaaggtctcctgcaaggcttnggatacaccttcaccgcctactatatgcactgggtgcgactcggcccctggacaagggcttggagtggatggggatggactcgacctaanggcggtggacacgaaagtatgacacgaagtaagtttcgaggtcgaagggtcaaccatacgaccgagggaacacgtccaatcgagccacgtaccataccacgacaaccgacgaccctaacgacgtacgggacctaggacggcgggcgcggacgaaaggcgacacgagnngnnnnnnnn

SEQ ID NO: 402366 - DNA, 489 bp, Homo sapiens
  misc_feature: GZ8MTXP02FRBPD.4.37.D04.1.454.CMB.2.raw
  modified_base (287)..(287): a, c, t, g, unknown or other
  modified_base (353)..(353): a, c, t, g, unknown or other
  modified_base (427)..(427): a, c, t, g, unknown or other
  modified_base (477)..(477): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtncgactggcccctggacaagggctgagtggatgggatggactcgacctaacagcggtgcacaaagtntgcacagaagtttcagggcagggtcaccgatgacccagggacacgtccatcagcacgtcatcagcacagcctanatggacctgacgcggctgacagtcacgacgacgacggcgtacttattcgngtgacgaggaag

SEQ ID NO: 402367 - DNA, 510 bp, Homo sapiens
  misc_feature: GZ8MTXP02I9K3V.4.37.D04.1.454.CMB.2.raw
  modified_base (250)..(250): a, c, t, g, unknown or other
  modified_base (356)..(356): a, c, t, g, unknown or other
  modified_base (435)..(435): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctcctgcaaggcttcnggatacaccttcaccgcctactatatgcacgtgggtgcgactcggcccctggacaagggcttgagtggatgggatggactccgacctagagcggtggcacgaagtntgacacgaagtaagttcgagggtcgagggtacaccgagtcgacgacggacacgtcaatcaagctacgtcatcagcaacngacctacagtgacctgacgcggctgacagtctacgaacgtcgacggtccgtatacgttctgtcggacgacggagg

SEQ ID NO: 402368 - DNA, 539 bp, Homo sapiens
  misc_feature: GZ8MTXP02JUTGG.4.37.D04.1.454.CMB.2.raw
  modified_base (250)..(250): a, c, t, g, unknown or other
  modified_base (356)..(356): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctctgcaaggcttcnggatacaccttcaccgcctactatatgcacgtgggtgcgactcggcccctggacaagggctgagtggatggatggactcgacctagaggcggtggcacgaaagtancgacaacgaggtaaacggtttcgggggactaggggtccaaccgagtcgaacccgagggaccacggtaccatcgagccacgtacatcagacactacgacctaacgagtacggacctagacgccggactggacctagcgacgacgacgaccggactaagtatttcggcgtagacggaggagtagg

SEQ ID NO: 402369 - DNA, 529 bp, Homo sapiens
  misc_feature: GZ8MTXP02GNWYD.4.37.D04.1.454.CMB.2.raw
  modified_base (371)..(371): a, c, t, g, unknown or other
  modified_base (515)..(515): a, c, t, g, unknown or other
  modified_base (528)..(528): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttcgtggataccaccttcaccgcctactatatgcacgtgggtgcgactcggcccctggacgaagggtcttggaggtggagtgggatggactccgacctaagaggcggtgacacgaaagtntgacacgagtaagttcgagggcgaggtcacgatcgaccgagggacacgtcatcagcacgcatcacgcacacgacctacgagtcggacctggacggtccggcgtggacgacggtccgacgaacgtacgacgtcgtagtcgttcgngacggacggaggng

SEQ ID NO: 402370 - DNA, 524 bp, Homo sapiens
  misc_feature: GZ8MTXP02FSA27.4.37.D04.1.454.CMB.2.raw
  modified_base (226)..(226): a, c, t, g, unknown or other
  modified_base (248)..(248): a, c, t, g, unknown or other
  modified_base (341)..(341): a, c, t, g, unknown or other
  modified_base (351)..(351): a, c, t, g, unknown or other
  modified_base (357)..(357): a, c, t, g, unknown or other
  modified_base (424)..(424): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaggtctctgcaggcttcnggatacaccttcaccgcctactatatgcacgtgggtgcgactcggcccctggacgaagggcttggagtggagtgggatggactcgacctaagngcggtgacanaaagtntagacaacgaggtaagtttcgacggggcgacggggtcaaccgagtacgaccgagggaccacgtccancagccacgtccatcacgacaccgacgacctacacgtcggacctggacggccggcgtagacgacgtcgcgacgacgacgcgtatgttacngtgacgaggag

SEQ ID NO: 402371 - DNA, 518 bp, Homo sapiens
  misc_feature: GZ8MTXP02H8P66.4.37.D04.1.454.CMB.2.raw
  modified_base (225)..(225): a, c, t, g, unknown or other
  modified_base (336)..(336): a, c, t, g, unknown or other
  modified_base (354)..(354): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaggtctctgcaaggctctgatacaccttcaccgcctactatatgcagtgggtgcgactcggcccctggacaagggcttggagtggatgggatggactcgaccctaanaggcggtgacacaaagtntcgacaacagtaagtttcgagggtcgaggggtacaccgagtcggaaccgaggggacaccgtaccatcacgcacgtccatcacgacacagacctacagtcgactgacgcgctgacagtctcgacgacgaccggaacgtacttacttcgtagtcgacggtaggagg

SEQ ID NO: 402372 - DNA, 498 bp, Homo sapiens
  misc_feature: GZ8MTXP02FNCSK.4.37.D04.1.454.CMB.2.raw
  modified_base (251)..(251): a, c, t, g, unknown or other
  modified_base (339)..(339): a, c, t, g, unknown or other
  modified_base (418)..(418): a, c, t, g, unknown or other
  modified_base (458)..(458): a, c, t, g, unknown or other
  modified_base (465)..(465): a, c, t, g, unknown or other
  modified_base (486)..(486): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcacgtgggtgcgactcggcccctggacaagggcttgagtgatggatggactcgaccctaanagcggtgcacgaaagtatcgacactaagtaacgtttcgagggtcgagggtcaacgatacgaccgagggacacgtaccancagcacgtccatcgagcacagctacatcgactgacgcgcngacatcngacacgacgcgtatacttcgngtcgcggaggag

SEQ ID NO: 402373 - DNA, 539 bp, Homo sapiens
  misc_feature: GZ8MTXP02IGAY8.4.37.D04.1.454.CMB.2.raw
  modified_base (373)..(373): a, c, t, g, unknown or other
  modified_base (444)..(444): a, c, t, g, unknown or other
  modified_base (527)..(527): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctcctgcaaggcttcgtggatacaccttcaccgcctaactatatgcacgtgggtcgcgactcggcccctggaacaagggcttggagtggagtgggatggactccgaacctaagaggcggtggacacgaaaagtanacgacaagagtaagttcgaggacgaggtacacgagacgacgacggacacgacacacgacgacgacgtacanacacgacacgacgacctacgacgtacgacgtagacggcggacgtacgacgacgtacgacgacgacgacgaacgtagtactcgngtacgcgaggag

SEQ ID NO: 402374 - DNA, 506 bp, Homo sapiens
  misc_feature: GZ8MTXP02JA7NI.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactggcccctggacgaagggcttggagtggatgggatggactcgacctacagcggtgacacaaagtatgacacgagtaagtttcgagggcgagggtcacgatagacgagggacacgtcatcacgcacgtcatcacgacacgacgacctacagtcggacctgacgccggctgacgagtcgacgacgacgacggcgtatacttctgtagcggaggag

SEQ ID NO: 402375 - DNA, 486 bp, Homo sapiens
  misc_feature: GZ8MTXP02I0D2C.4.37.D04.1.454.CMB.2.raw
  modified_base (433)..(433): a, c, t, g, unknown or other
  modified_base (476)..(477): a, c, t, g, unknown or other
  modified_base (479)..(486): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctctgcaaggcttctggatacaccttcaccgcctactatatgcacgtggtgcgactcggcccctggacaagggcttgagtggatgggatggatccgaccctaagaggcggtggcacgaaagtatgcacgagtaagtttcgagggcagggtcaacgatgacgagggacacgtccatcagcacgtcatcagcacagcctanacgtcggacctgacggcgggctaggcgaaaggcgcgacgtagnngnnnnnnnn

SEQ ID NO: 402376 - DNA, 520 bp, Homo sapiens
  misc_feature: GZ8MTXP02F1NS6.4.37.D04.1.454.CMB.2.raw
  modified_base (510)..(510): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgtggatacaccttcaccgcctactatatgcacgtgggtgcgacgtcggccccctggacaagggtcttggaggtggagtgggatggactccgaccctaagacggcggtggacacgaaagtagtgacaacgagtaaagtttcgagggcgagggtacacagtacgaccgagggacacgtacatcacgcacgtcatcacgcacagacctacagtcgactgacgcggcgtagacgacgcgtacgacgacgacgcgtatcttcgngcgcgaggag

SEQ ID NO: 402377 - DNA, 480 bp, Homo sapiens
  misc_feature: GZ8MTXP02FHSJ8.4.37.D04.1.454.CMB.2.raw
  modified_base (220)..(220): a, c, t, g, unknown or other
  modified_base (233)..(233): a, c, t, g, unknown or other
  modified_base (243)..(243): a, c, t, g, unknown or other
  modified_base (278)..(278): a, c, t, g, unknown or other
  modified_base (308)..(308): a, c, t, g, unknown or other
  modified_base (338)..(338): a, c, t, g, unknown or other
  modified_base (407)..(407): a, c, t, g, unknown or other
  modified_base (436)..(436): a, c, t, g, unknown or other
  modified_base (444)..(444): a, c, t, g, unknown or other
  modified_base (477)..(477): a, c, t, g, unknown or other
  modified_base (479)..(479): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccagtgcagctgtgcagtctgggctgaggtgaagagcctgggcctnagtgaggtctccngcaaggctcnggatacacctcaccgcctactatatgcactgggtncgactggcccctggacaaggctgagtggangggatggactcgaccctaagagcggtggcncaaagtatgcacagtaaagtttcaagggtcagggtcaccgatcgaccagggacacgtccatcagcacanccatcagccacacgcctacatcggaccgngacgcgcncgacacgcacgacgacgcgctatctcgtcgcgngng

SEQ ID NO: 402378 - DNA, 555 bp, Homo sapiens
  misc_feature: GZ8MTXP02H5XAO.4.37.D04.1.454.CMB.2.raw
  modified_base (256)..(256): a, c, t, g, unknown or other
  modified_base (295)..(295): a, c, t, g, unknown or other
  modified_base (368)..(368): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggatgatcctcttcttggtggcagcagccacaggagccccactcccaggtgcagctggtgcagtcgtggggctggaggtgaagaagccgtggggcctcgagtgaaggtctcctgcaaggcttcnggatacaccttcaccgcctactatatgcacgtggggtcncgacgtcggcccctggacaagggcttgagtgagtgggatggatccgacctaacgagcggtggcaacgaaagtntagacacgagtagttcgagggcagggtcacagtacgacgaggacacgtcatcagcgacgtcatcgagccaacacgcctaacgacgtacggaccgtacggacggccgggaccgttcggaactaacgtccgtacggaaccgaacgaaccggtccgttaaagttactttccgtcggtcggacggaagggg

SEQ ID NO: 402379 - DNA, 576 bp, Homo sapiens
  misc_feature: GZ8MTXP02IW0ZA.4.37.D04.1.454.CMB.2.raw
  modified_base (225)..(225): a, c, t, g, unknown or other
  modified_base (286)..(286): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtgggcctnagtgaggtctcctgcaaggcttctggatacaccttcaccgcctactatatgacacgtgggngcgacgtcggcccctggacaaggggtcttggagtggagtgggatggactccggaaccctagacggtcggtacggacacgtaaagtagtacgaccaacgtaaggtaaacggtttcgaagggggtcgtaaggggtaccaacgagtacgaaccgaggggaccacggtaccatccgaagccaaccgtccagtaccgacgaccacacgcctacgagtcggactggacggcgcctaggactacgctacgacgtacgacgtaacgtattaacgttcgtaggtcgacgggaggtacgg

SEQ ID NO: 402380 - DNA, 493 bp, Homo sapiens
  misc_feature: GZ8MTXP02GYES3.4.37.D04.1.454.CMB.2.raw
  modified_base (251)..(251): a, c, t, g, unknown or other
  modified_base (337)..(337): a, c, t, g, unknown or other
  modified_base (356)..(356): a, c, t, g, unknown or other
  modified_base (483)..(483): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcatgggtgcgactggcccctggacaagggcttgagtggatgggatggactcgacctaanagcggtggacacgaaagtntgcacagaaagtttcagggcagggtcacgatgacagggacacgtccatcagcacgtccatcagcacagcctacatcggacctgacgcggacctggacagtcgcgacgacgacggccgtatacgttcngtgcgaggag

SEQ ID NO: 402381 - DNA, 542 bp, Homo sapiens
  misc_feature: GZ8MTXP02H3ND2.4.37.D04.1.454.CMB.2.raw
  modified_base (287)..(287): a, c, t, g, unknown or other
  modified_base (361)..(361): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgctactatatgcactgggtncgactcggcccctggacagggcttggagtggatgggatggactccgacctaacaggcggtggcacgaaagttangacagagtagttcgaggcgaggcacgagacgacgacggacgacgtcacgacacgacaccgtacacgacgacgacaacgacgacctacgacgtacggacgtacggacggccggcgtacgacgtacgtacgacgacgaccgaccggtaacgttacgttacgttacgtggtacggaggaggagg

SEQ ID NO: 402382 - DNA, 529 bp, Homo sapiens
  misc_feature: GZ8MTXP02G3YLE.4.37.D04.1.454.CMB.2.raw
  modified_base (289)..(289): a, c, t, g, unknown or other
  modified_base (364)..(364): a, c, t, g, unknown or other
  modified_base (479)..(479): a, c, t, g, unknown or other
  modified_base (516)..(516): a, c, t, g, unknown or other
  modified_base (528)..(528): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctgagtgaaggtctcctgcaaggcttcgtggatacaccttcaccgctactatatgcagtgggtncgacgtcggcccctggacgagggcttggagtggagtgggatggactccgacctaagagcggtagacacgaaagtnacgacactaaggtagtttacgagggacgacgggtcacgatcgaacgacgggacacgtaccactcgacgccacgtccaacacaacacacgacctacagtcggacctgacgcggacnggacacgtacacgacgacgacgactaagtacttacgngcgacgacgagng

SEQ ID NO: 402383 - DNA, 595 bp, Homo sapiens
  misc_feature: GZ8MTXP02F8E1M.4.37.D04.1.454.CMB.2.raw
  modified_base (256)..(256): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcaaggcttcnggactacaccttcaccgcctactatatgcacgtgggtcgcgacgtcggcccctggacgaagggtcttgaggtggagtgggagtggactccgaccctaagacggtcggtaggacacgtaaagtataggaccaacgtaaggtaagtttcggaacggggtcgacggggtaccaacgtagtacgaaaccgaggggaactagttcgaccgatacgacgaccgacgttaccatacgacgaccacgacgacctaacgacgtacggacctggacgccgggcctacgactacgtcgtacggacgaccgtaacggtaccgtattacgttcgaggtcggacggtaagggg

SEQ ID NO: 402384 - DNA, 534 bp, Homo sapiens
  misc_feature: GZ8MTXP02GK56C.4.37.D04.1.454.CMB.2.raw
  modified_base (334)..(334): a, c, t, g, unknown or other
  modified_base (350)..(350): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggctcagtgaaggtctcctgcaaggcttctggatacaccttcaccgcctactatatgcacgtgggtgcgactggcccctggacaagggcttgagtggatgggatggatccgacctanagcggtggacacagtntgcacagaagtttcgagggtcagggtcaccgatagaccgagggacacgtccatcagacacgtaccagtcagacacacgacctacacgtcggacctgacgccggactaggacacgttcacggaaccgaccgacggtacccgtaattacgtttaccgtggttacgcggtaacggggtagtaagggg

SEQ ID NO: 402385 - DNA, 529 bp, Homo sapiens
  misc_feature: GZ8MTXP02JNUGA.4.37.D04.1.454.CMB.2.raw
  modified_base (337)..(337): a, c, t, g, unknown or other
  modified_base (354)..(354): a, c, t, g, unknown or other
  modified_base (458)..(458): a, c, t, g, unknown or other
  modified_base (470)..(470): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtgcgactcggcccctggacaagggcttgagtgatggatggactcgacctanagcgtgacacgaaagtntgacacgagtaacgtttcgagggcgagggtacaccgagtacgaccgaggggaccacgtccagtcacggtcacgtccatcagacacacgcctacgagtcggaccnggacgccggccnggaccatcgtacgaaccgacgaccggtaacgtacttacgttctggtcgacggaggaagg

SEQ ID NO: 402386 - DNA, 541 bp, Homo sapiens
  misc_feature: GZ8MTXP02H7IRB.4.37.D04.1.454.CMB.2.raw
  modified_base (248)..(248): a, c, t, g, unknown or other
  modified_base (439)..(439): a, c, t, g, unknown or other
  modified_base (525)..(525): a, c, t, g, unknown or other
  modified_base (539)..(539): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagcgtgggctgagtgaggtctctgcaggctcgnggataccaccttcaccgctactatatgcacgtggggtcgcgacgtcggccccctgggaacgaaggggtcttaggagtggagtgggatggactacgaccctaagaggcggtggacacgtaaagtatcgacaacgagtaaagtttcgagggcgaggtaccacgagcgaccgaggacacgccatcagcactcanacagacacacgacctacacgtacggaccgtgacggcggccgtagacagtacgacgaccgaacgacggtaaccgtattacgtttcgngtacggacggaggngg

SEQ ID NO: 402387 - DNA, 562 bp, Homo sapiens
  misc_feature: GZ8MTXP02HJ06T.4.37.D04.1.454.CMB.2.raw
  modified_base (227)..(227): a, c, t, g, unknown or other
  modified_base (239)..(239): a, c, t, g, unknown or other
  modified_base (248)..(248): a, c, t, g, unknown or other
  modified_base (453)..(453): a, c, t, g, unknown or other
  modified_base (490)..(490): a, c, t, g, unknown or other
  modified_base (518)..(518): a, c, t, g, unknown or other
  modified_base (550)..(550): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctnagtgagtctccngcaggctcnggatacaccttcaccgcctactatatgcacgtgggtgcgtacgtcggcccctggacgaagggtcttggagtggagtggggatggactccgaacctaacgaggtcggtacgacacgaaagtatcgacaacgagtaacgttcgagggtcgagggtcacgagtcgaaccgagggactaccgtaccactacgacgccgtacgtcctaanaccgacgaccaacacgacctaacgacgtacggaccgnggacggccggacgtagacgaacggtccncgaacgacgacggtaaccgtagttacgttcgngcgacggaggag

SEQ ID NO: 402388 - DNA, 512 bp, Homo sapiens
  misc_feature: GZ8MTXP02IF886.4.37.D04.1.454.CMB.2.raw
  modified_base (426)..(426): a, c, t, g, unknown or other
  modified_base (500)..(500): a, c, t, g, unknown or other
  modified_base (503)..(503): a, c, t, g, unknown or other
  modified_base (505)..(505): a, c, t, g, unknown or other
  modified_base (511)..(511): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttctggatacaccttcaccgcctactatatgcactgggtgcgactggccccctggacaagggcttggagtggatgggatggactcgaccctacaggcggtggctacgaaagtatcgacacaggtaagtttcgagggtcgaggggtacaccgagtgaccgaggggacacggtaccancagcaccgtcatcagcacagacctacacgtgaccgtagacgcggctggacaacgcacgacgacacggcgtattntcngngcgagng

SEQ ID NO: 402389 - DNA, 561 bp, Homo sapiens
  misc_feature: GZ8MTXP02JQCQK.4.37.D04.1.454.CMB.2.raw
  modified_base (225)..(225): a, c, t, g, unknown or other
  modified_base (237)..(237): a, c, t, g, unknown or other
  modified_base (246)..(246): a, c, t, g, unknown or other
  modified_base (281)..(281): a, c, t, g, unknown or other
  modified_base (356)..(356): a, c, t, g, unknown or other
  modified_base (416)..(416): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaggtctcngcaggctcngatacaccttcaccgctactatatgcacgtgggtncgacgtcggcccctggacgaagggtcttggagtggagtgggatggactcgacctaagaggcggtgacagaaagtntgacagagtaagttcgagggcgtagggtacacgtagtcgaccgaggggaccacgtaccanacgacgcacgtacagacacgacacgacgacctaacgacgtacggaccgtacggacggtccggtacgtacggactacgtaccggtaccgaaccgtacgtaccggtaaccgttagttacgttacgtaggtacggacggtacgggtag

SEQ ID NO: 402390 - DNA, 516 bp, Homo sapiens
  misc_feature: GZ8MTXP02HA9K0.4.37.D04.1.454.CMB.2.raw
  modified_base (245)..(245): a, c, t, g, unknown or other
  modified_base (251)..(251): a, c, t, g, unknown or other
  modified_base (278)..(278): a, c, t, g, unknown or other
  modified_base (330)..(330): a, c, t, g, unknown or other
  modified_base (332)..(332): a, c, t, g, unknown or other
  modified_base (334)..(334): a, c, t, g, unknown or other
  modified_base (345)..(345): a, c, t, g, unknown or other
  modified_base (504)..(504): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctgagtgagtctctgcagctngatacnccttcaccgctactatatgcacgtggngcgactcggccctggacgaagggcttgagtggatggatggactcgacctagngngngacacaaagtngacagagtaagttcgagggcgaggtacacgagtacgacgacggacacgtacatcgagaccacgtaccatacacgaccaacacgacctaacgacgtacggaccgtggacggacggcgtacgaacgtacgacgacgacgacgacgtaactacgttcgtggngacggaggagag

SEQ ID NO: 402391 - DNA, 512 bp, Homo sapiens
  misc_feature: GZ8MTXP02J1XON.4.37.D04.1.454.CMB.2.raw
  modified_base (252)..(252): a, c, t, g, unknown or other
  modified_base (344)..(344): a, c, t, g, unknown or other
  modified_base (349)..(349): a, c, t, g, unknown or other
  modified_base (501)..(501): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagaagccgtggggcctgagtgaaggtctcctgcaggcttcnggatacaccttcaccgcctactatatgcacgtgggtgcgacgtcggccccgtggacagggcttggagtggatgggatggactcgacctaagngcggngacacaagtatgacacgagtaagttcgagggcgaggtacacgagtcgaccgagggacacgtcatcacgcaccgtcatcacgacacgacgacctacagtcggaccgtggacgcggcgtggacagtcgacgacgacgacggtctagtcgttcgngtgcgaggagg

SEQ ID NO: 402392 - DNA, 556 bp, Homo sapiens
  misc_feature: GZ8MTXP02JYH10.4.37.D04.1.454.CMB.2.raw
  modified_base (250)..(250): a, c, t, g, unknown or other
  modified_base (257)..(257): a, c, t, g, unknown or other
  modified_base (360)..(360): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaggcttcnggatacnccttcacccgctactatatgcactgggtgcgactcggcccctaggacaagggcttgagtggatgggatggactcgacctaacgaggcggtggacacgaaagtntggacacgaagtaaacgtttcgaggggtcgacggggtcaaccgagtacgaccgaggggacaccgtccgactacgagccgacgtccatcgacggaccacgacgtacctaacgacgtcggaaccctggaacggtccgggactcggaaccgacgttcgacgacggaacgacgtaacgtatacttcgtggcgacgaggag

SEQ ID NO: 402393 - DNA, 520 bp, Homo sapiens
  misc_feature: GZ8MTXP02G8SH9.4.37.D04.1.454.CMB.2.raw
  modified_base (250)..(250): a, c, t, g, unknown or other
  modified_base (343)..(343): a, c, t, g, unknown or other
  modified_base (362)..(362): a, c, t, g, unknown or other
  modified_base (505)..(505): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaggctcnggatacaccttcaccgcctactatatgcacgtgggtgcgactcggcccctggacaagggcttggagtggagtgggatggactcgaccctaagnggcggtggacacgaaagtntcgacacgagtagtttcgagggcgagggtcacgatcgacgacgggacacgtcatcgagcacgtcaagtcacgacacgacacctagactcggaccaggacgcggcctaggacacgtcgacgacgtacgacgcgtatacgttcgngtcgacggaggacgg

SEQ ID NO: 402394 - DNA, 534 bp, Homo sapiens
  misc_feature: GZ8MTXP02IJYPY.4.37.D04.1.454.CMB.2.raw
  modified_base (345)..(345): a, c, t, g, unknown or other
  modified_base (364)..(364): a, c, t, g, unknown or other
  modified_base (424)..(424): a, c, t, g, unknown or other
  modified_base (441)..(441): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtggggcctcagtgaaggtctcctgcaaggtcttcgtggatactaccttcaccgctactatatgcacgtggtgcgactcggcccctggacgaggcttggagtggagtgggatggactccgaccctaagnggcggtggacacgaagtangacacgagtaagttcgagggcaggtcacgatcgacgaggacacgtcatcacgcacgtcanacagacacgacacctanacgtacggacgacgacggcggactcgaacgtacgtacgacgaacgaccgtacggtaaccgttaataccgttcgtaggcggacggaggtaaggg

SEQ ID NO: 402395 - DNA, 536 bp, Homo sapiens
  misc_feature: GZ8MTXP02HJZD8.4.37.D04.1.454.CMB.2.raw
  modified_base (252)..(252): a, c, t, g, unknown or other
  modified_base (288)..(288): a, c, t, g, unknown or other
  modified_base (327)..(327): a, c, t, g, unknown or other
  modified_base (341)..(341): a, c, t, g, unknown or other
  modified_base (358)..(358): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccgcctactatatgcacgtgggngcgactcggcccctggacaagggcttgagtggagtgggntggactcgacctangcggtgcacgaaagtangacacagaagttcgagggtcagggtcacgagtacgacgagggacacggtcatcaacgcaccgtccagtacacgacacgtacacctaacgacgtcggacctaggacgccggctagacgacgtacgacgacgaacgcggtaaccgtattaacgtttacggtcggtcggacggacggtagg

SEQ ID NO: 402396 - DNA, 538 bp, Homo sapiens
  misc_feature: GZ8MTXP02JS2L3.4.37.D04.1.454.CMB.2.raw
  modified_base (253)..(253): a, c, t, g, unknown or other
  modified_base (468)..(468): a, c, t, g, unknown or other
  modified_base (480)..(480): a, c, t, g, unknown or other
  modified_base (526)..(526): a, c, t, g, unknown or other
  modified_base (537)..(537): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctctgcaggcttcnggatacaccttcacccgtcctactatagtgcacgtgggtcgcgaccgtcgggccccctagggaaccgaaggggtcttggaggtggaagtggggatggacctccgacctagaggcggtgacacgaaagtctgacaagagtacgttgagggcaggtcacagtcgacgacggacacgtcactcgacgcaccgtccatacacgacaacgacgaccgtanacgtacggtacnggacgcggctaggacacgtcacgacgacgacggtcgtatagttcgngcgacggaggng

SEQ ID NO: 402397 - DNA, 528 bp, Homo sapiens
  misc_feature: GZ8MTXP02G6IX6.4.37.D04.1.454.CMB.2.raw
  modified_base (224)..(224): a, c, t, g, unknown or other
  modified_base (286)..(286): a, c, t, g, unknown or other
  modified_base (358)..(358): a, c, t, g, unknown or other
  modified_base (523)..(523): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctnagtgaaggtctcctgcaaggcttctggatacaccttcaccgcctactatatgcacgtgggtncgactcggcccctggacaagggctgagtggagtgggatggatcccgaccctacaggcggtggacaacaagtntgacacgagaagtttcgagggcagggtacacagtcgaccgaggacacgtcagtcagcacgtcatacacgacacacgacctaacgacgtcggtaccctaggacggcccgggtactacggacaacggtcacggacgacgacggtctaatcgtacgtgcgacgacggngtagg

SEQ ID NO: 402398 - DNA, 559 bp, Homo sapiens
  misc_feature: GZ8MTXP02JDCI5.4.37.D04.1.454.CMB.2.raw
  modified_base (247)..(247): a, c, t, g, unknown or other
  modified_base (283)..(283): a, c, t, g, unknown or other
  modified_base (451)..(451): a, c, t, g, unknown or other
  modified_base (544)..(544): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcagtgaggtctctgcaggctcnggatacaccttcaccgcctactatatgcacgtgggngcgactcggcccctggacaagggcttggagtggagtgggatggactccgacctacgaggcggtgacacgaaagtatcgacaacgagtaacggtttcgaaggggcgagggtccaacgagtacgacccgaggggaccaccgtaccacgtacgacgccgaccgtaccctanccagaccacgacgacctaacacgtacggaccgtggacggccgggcctggacccgtagtaccgacgaaccgacgacggtccgtagttacttcgngtcggacggaggagg

SEQ ID NO: 402399 - DNA, 484 bp, Homo sapiens
  misc_feature: GZ8MTXP02GCCC5.4.37.D04.1.454.CMB.2.raw
  modified_base (287)..(287): a, c, t, g, unknown or other
  modified_base (338)..(338): a, c, t, g, unknown or other
  modified_base (347)..(347): a, c, t, g, unknown or other
  modified_base (353)..(353): a, c, t, g, unknown or other
  modified_base (423)..(423): a, c, t, g, unknown or other
  modified_base (447)..(447): a, c, t, g, unknown or other
  modified_base (471)..(471): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtncgactggcccctggacaagggcttgagtggatgggatggactcgacctaangcggtgcanaaagtntgcacagtaaagttcagggcaggtcacgatgaccagggacacgtcatcagcacgtcatcagcacagctanatcgactgacgcggcctagcatcncgacgacacggccgtatactttcngtcgacgaggtag

SEQ ID NO: 402400 - DNA, 506 bp, Homo sapiens
  misc_feature: GZ8MTXP02I9IGU.4.37.D04.1.454.CMB.2.raw
  modified_base (286)..(286): a, c, t, g, unknown or other
  modified_base (360)..(360): a, c, t, g, unknown or other
  modified_base (436)..(436): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcacgtgggtncgactcggcccctggacaagggcttgagtggagtgggatggatcccgaccctaagagcggtgaccaacgaagtntgcacagtaagtttcgagggcagggtcacgatgaccgaggaccacgtcatcagcacgtccatcagcacagcctacngtacggcctgacgcggctgacactcacgacgacgccggacgtaatacgttcgaggtgacggaggagtagg

SEQ ID NO: 402401 - DNA, 559 bp, Homo sapiens
  misc_feature: GZ8MTXP02G7OIZ.4.37.D04.1.454.CMB.2.raw
  modified_base (253)..(253): a, c, t, g, unknown or other
  modified_base (364)..(364): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcnggatacaccttcaccgcctactatatgcacgtgggtgcgactcggcccctggaacagggtcttggagtggagtgggatggactccgacctagaggcggtgacacgaaagtntacgacacaggtaagtttcgagggcacggggtcaacgagtacgaaccgaggggactacgtaccatcgaacgccaccgtcagtacagaccacgacgacctaacacgtcggaacctggacgaccggtctgaactacgtcgacggaccgacgtaccgggtccgttaattcgtttacgtgtacggcgggagggtaacgg

SEQ ID NO: 402402 - DNA, 531 bp, Homo sapiens
  misc_feature: GZ8MTXP02IYFPL.4.37.D04.1.454.CMB.2.raw
  modified_base (286)..(286): a, c, t, g, unknown or other
  modified_base (343)..(343): a, c, t, g, unknown or other
tcagagcactgtagcacgaccggtgctcgatttagtagcatactgttgggtttgggggagcatcaccccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctgagtgaggtctctgcaggcttcgtgatacaccttcaccgcctactatatgcacgtggngcgacgtcggcccctggacgaggcttggagtggagtgggatggactccgacctaagngcggtgacagaagtatgacagagtagttcgagggcgaggtcacgatacgacgagggacacgtccatcagactacgccatccagaccacgacgacctagatcggaccgtagacggccgctagactactcgtacggaaccgaccgacggtaacccgttattacgtttcgaggtacggacggagggtaagg

SEQ ID NO: 402403 - DNA, 499 bp, Homo sapiens
  misc_feature: GZ8MTXP02HSC7Q.4.37.D04.1.454.CMB.2.raw
  modified_base (221)..(221): a, c, t, g, unknown or other
  modified_base (243)..(243): a, c, t, g, unknown or other
  modified_base (323)..(323): a, c, t, g, unknown or other
  modified_base (334)..(334): a, c, t, g, unknown or other
  modified_base (383)..(383): a, c, t, g, unknown or other
  modified_base (427)..(427): a, c, t, g, unknown or other
  modified_base (434)..(434): a, c, t, g, unknown or other
  modified_base (439)..(439): a, c, t, g, unknown or other
  modified_base (490)..(490): a, c, t, g, unknown or other
  modified_base (498)..(498): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggacgcccactccccaggtgcagctggtgcagtctgggctgagtgaagagcgtgggctnagtgaggtctctgcaggcttcnggatacaccttcaccgcctactatatgcacgtggtgcgactcggccccgtggacagggcttgagtggagtgggatggacncccgaccctangcggtgcaacagtatcgacacgtagagtttcgagggcgaaggtcacganacggaaccaagggacctacgtcccaatcagcaacgtccatcganccacgancctanagtcgacctgacgcgactggaccagcacgacacgtacgcaagttctcgcgngcgagagng

SEQ ID NO: 402404 - DNA, 548 bp, Homo sapiens
  misc_feature: GZ8MTXP02JD5R2.4.37.D04.1.454.CMB.2.raw
  modified_base (535)..(535): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcgaaggcttctggatacacccttcacccgcctactatatgcactgggtgcgactggccccctggacaaggggtcttgagtggagtggggatggactccgaaccctaacgaggcggtacggcacgaaagtatggacaacgaggtaaacgtttcgaggggcgaggggtcaaccagtacgaccgacggggacacggtaccagtacagccaccggtcatccagccaacgacgacctacagtcggaacctgacggccggcgtagaccagtcgagacgacgacgccggtatacgttcgngtcggacgaggag

SEQ ID NO: 402405 - DNA, 524 bp, Homo sapiens
  misc_feature: GZ8MTXP02HS93J.4.37.D04.1.454.CMB.2.raw
  modified_base (252)..(252): a, c, t, g, unknown or other
  modified_base (347)..(347): a, c, t, g, unknown or other
  modified_base (365)..(365): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaggcttcnggatacaccttcaccgcctactatatgcacgtgggtgcgactcggcccctaggaccgaagggtcttagagtggagtgggatggactcgaccctanagtctggtgcacaaagtntgacacgagtacgttcgagggtcgagggtcacgatacggaccgagggacaccgtacataccgaggccacggtaccatacagacacacgcctacgatcggactggacgcgggctacggactacgcgacgaacgacgaacgtcgtaatctctggtcgagag

SEQ ID NO: 402406 - DNA, 528 bp, Homo sapiens
  misc_feature: GZ8MTXP02HNC4U.4.37.D04.1.454.CMB.2.raw
  modified_base (246)..(246): a, c, t, g, unknown or other
  modified_base (352)..(352): a, c, t, g, unknown or other
  modified_base (457)..(457): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctgagtgaggtctctgcagctngatacactcaccgctactatatgcacgtggtcgcgacgtcggcccctggacaggcttggagtgagtgggatggactcgaaccctagacggcggtagcacgaaagtntagaccaacgaggtaaagttcgaggcgagggtcaacgagtcgacgaggacacgtcacgacagccacgtacactcacgaccaacacgacctacacgtacggaccgnggacggcggccgtagacgagtaccgcgacgtacgaccggtaaccgtattacgttcgtgcggcggtaggagg

SEQ ID NO: 402407 - DNA, 518 bp, Homo sapiens
  misc_feature: GZ8MTXP02JBA8W.4.37.D04.1.454.CMB.2.raw
  modified_base (507)..(507): a, c, t, g, unknown or other
  modified_base (517)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttctggataccaccttcaccgcctactatatgcacgtgggtgcgactcggcccctggacagggcttgagtggagtgggatggactcgaccctaacgagcggtgacagaaagtatgacacgaagtagttcgaggggcagggtcaccgagtacgaccagggacacgtcagtcagaccacgtaccatcgagacaacgcgacctacgacgtcggaccgtgaacgcggcctaggaccagtcgacgacgacgacgcgtatattcgngtcgacgagng

SEQ ID NO: 402408 - DNA, 513 bp, Homo sapiens
  misc_feature: GZ8MTXP02H97YA.4.37.D04.1.454.CMB.2.raw
  modified_base (252)..(252): a, c, t, g, unknown or other
  modified_base (499)..(499): a, c, t, g, unknown or other
  modified_base (501)..(501): a, c, t, g, unknown or other
  modified_base (504)..(504): a, c, t, g, unknown or other
  modified_base (508)..(508): a, c, t, g, unknown or other
  modified_base (512)..(512): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaggcttcnggatacaccttcaccgcctactatatgcacgtgggtgcgacgtcggccccgtggacgaagggcttgaggtggagtgggatggactacgaccctaagacggcggtggacacgaaaggtatagcaacgagtaagtttcgagggcgagggtcaccagtcgaccgagggacacgtccatcagccacgtccatcagcacagcctacagtcgaccgtgacgtcggactaggaccaggcgacgagagacgtgtntntgngcgngagng

SEQ ID NO: 402409 - DNA, 528 bp, Homo sapiens
  misc_feature: GZ8MTXP02II0UM.4.37.D04.1.454.CMB.2.raw
  modified_base (254)..(254): a, c, t, g, unknown or other
  modified_base (357)..(357): a, c, t, g, unknown or other
  modified_base (369)..(369): a, c, t, g, unknown or other
  modified_base (421)..(421): a, c, t, g, unknown or other
  modified_base (433)..(433): a, c, t, g, unknown or other
  modified_base (450)..(450): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaggtctctgcaaggctcgnggactactaccttcaccgcctactatatcgcagtgggtgcgacgtcggcccctggacgagggctaggaggtgagtgggatggactccgaacctagaggtcggngacacgaaagtntcgacacgtagtaagttcgaggcgaggtcacgatcgaccgaggacacgtcancgagcacgtcanacagcacacgactacgngtacgacgtgacgcgcctagacagttacncgtaacgccgaccggtaacgtacttacgttcgtggtacgacggaggagg

SEQ ID NO: 402410 - DNA, 527 bp, Homo sapiens
  misc_feature: GZ8MTXP02HXUT8.4.37.D04.1.454.CMB.2.raw
  modified_base (249)..(249): a, c, t, g, unknown or other
  modified_base (256)..(256): a, c, t, g, unknown or other
  modified_base (359)..(359): a, c, t, g, unknown or other
  modified_base (417)..(417): a, c, t, g, unknown or other
  modified_base (517)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcagtgaaggtctcctgcaggctntgatacncttcaccgcctatatatgctagtgggtcgcgacgtcggcccctggacgaagggcttggagtggatggggatggactcgacctagagcggtggacacgaaagtngacacgagtaagtttcgaggtacgagggtacacgatacgaacgacggacacgtaccanacgagacacgtacatcacgcaacgacgacctacgactacggacgacggacgccggcgacgacgacgtcgacgaccgacgacggtaaccgtatacgttcgngacgcgagag

SEQ ID NO: 402411 - DNA, 541 bp, Homo sapiens
  misc_feature: GZ8MTXP02HIJJV.4.37.D04.1.454.CMB.2.raw
  modified_base (251)..(251): a, c, t, g, unknown or other
  modified_base (349)..(349): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctcctgcaaggcttcnggatacaccttcacccgcctactatatgcacgtgggtcgcgacgtcggcccctggacgaagggcttggagtggagtgggatggactccgaccctaagnggtcggtggacacgaaagtatcgacacgagtaagtttcgagggcgagggtcacgagtacgaccgagggacacgtacactcgacgactaccgtccatcacgaccacgacgacctacacgtcggaccgtgacgtcggacctgactacgcgtacgaccgtacgacgtccgtatacgttcgagtcgacggaggagg

SEQ ID NO: 402412 - DNA, 630 bp, Homo sapiens
  misc_feature: GZ8MTXP02H8SS7.4.37.D04.1.454.CMB.2.raw
  modified_base (193)..(193): a, c, t, g, unknown or other
  modified_base (250)..(250): a, c, t, g, unknown or other
  modified_base (421)..(421): a, c, t, g, unknown or other
  modified_base (450)..(450): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcngtctgggctgaggtgaagagccgtgggcctgagtgaaggtctccgtgcaaggcttcnggactacctaccttcaccgtctactatatgcacgtgggtcgcgaccgtcggccccgtaggacgaagggtcttggaagtggagttggggatggacctaccgacctaaagcggtcggtaggacacgtaaaaggtctagacaacgtagtaagtttcagggcgagggtccaacgngtacgaaccgtagggaccacggtacctanacgacggacctaccggtacactacgaacgaccgaacacgaccctacgacgttacgggaacctcgggaacggccggtccgtaaggaccgtaacgtccgttaacggaacccgttaacggaccggttaaccgttaacgtttaacgtttccggtaggttaccggacggggttaacggtaagggg

SEQ ID NO: 402413 - DNA, 508 bp, Homo sapiens
  misc_feature: GZ8MTXP02IS74M.4.37.D04.1.454.CMB.2.raw
  modified_base (226)..(226): a, c, t, g, unknown or other
  modified_base (246)..(246): a, c, t, g, unknown or other
  modified_base (267)..(267): a, c, t, g, unknown or other
  modified_base (342)..(342): a, c, t, g, unknown or other
  modified_base (361)..(361): a, c, t, g, unknown or other
  modified_base (367)..(367): a, c, t, g, unknown or other
  modified_base (394)..(394): a, c, t, g, unknown or other
  modified_base (439)..(439): a, c, t, g, unknown or other
  modified_base (494)..(494): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagagccgtgggcctnagtgagtctctgcagcttcngatacacttcaccgctactanatgcagtgggtcgcgacgtcggccccctggacgaagggtcttggagtggagtggggatggactccgacctaacgnggcggtgacacgaaagtangacaanagtaagttcgagggcgaggtacacagngacgaggacacgtacatcacgcacgtcatcagcacgacgacctancgtcggactggacgcgctgacagtacgcgaacgtacgacggaacttatacttcgngtacggcgaggagg

SEQ ID NO: 402414 - DNA, 517 bp, Homo sapiens
  misc_feature: GZ8MTXP02JK9TW.4.37.D04.1.454.CMB.2.raw
  modified_base (346)..(346): a, c, t, g, unknown or other
  modified_base (364)..(364): a, c, t, g, unknown or other
  modified_base (437)..(437): a, c, t, g, unknown or other
  modified_base (443)..(443): a, c, t, g, unknown or other
  modified_base (500)..(500): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttctggatacaccttcaccgcctactatatgcagtgggtgccgacgtcggccccctggacaaggggcttaggagtggatgggatggatccgacctanaggcggtgcacgaaagtntgccagagtagttcgaaggcgagggtcactatagaccagggaccacgtcatcaggcacgtccagtcagacacngcctanagtcgactgacgcgcctagactatccgagaccgacgtaccggccgtatacgtttcgngtacgacggtaggaagg

SEQ ID NO: 402415 - DNA, 527 bp, Homo sapiens
  misc_feature: GZ8MTXP02H9BVF.4.37.D04.1.454.CMB.2.raw
  modified_base (226)..(226): a, c, t, g, unknown or other
  modified_base (288)..(288): a, c, t, g, unknown or other
  modified_base (340)..(340): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaaggtctcctgcaaggcttctggatacaccttcaccgcctactatatgcacgtgggtncgactcggcccctggacagggctgagtggatgggatggactcgaccctaagnggcggtggacacaaagtatgacaagagaaagtttcgagggtcagggtacaccgatcgaccgaacgggacaacgtccgatacgacgcaccgtacagtcagcacacgacctacagtcggacgtagacggcgctaggacagtcgtacgacgacgacggtaaccgtatacgtttcgngtacgacggaggag

SEQ ID NO: 402416 - DNA, 487 bp, Homo sapiens
  misc_feature: GZ8MTXP02JU8MG.4.37.D04.1.454.CMB.2.raw
  modified_base (336)..(336): a, c, t, g, unknown or other
  modified_base (345)..(345): a, c, t, g, unknown or other
  modified_base (442)..(442): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggactcgacctanagcggtgcncaaagtatgacacagaagtttcagggcgaggtcacatgacagggacacgtcatcagcacgtcatcagcacacgcctacatcggacctgaagcggtcngacagttcgcgacgacgacggccgtatacgttctgtgcggaggag

SEQ ID NO: 402417 - DNA, 607 bp, Homo sapiens
  misc_feature: GZ8MTXP02HDZ8F.4.37.D04.1.454.CMB.2.raw
  modified_base (225)..(225): a, c, t, g, unknown or other
  modified_base (246)..(246): a, c, t, g, unknown or other
  modified_base (250)..(250): a, c, t, g, unknown or other
  modified_base (377)..(377): a, c, t, g, unknown or other
  modified_base (511)..(511): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagcgtgggcctnagtgaggtctctgcaagctcngganacacctcaccgcctactatatgcacgtgggtgcgactcggaccacgtggacgaaggggtcttaggagtggagtggggatcgggactccgacccctaagacgggtcggtcggcgaaacgtaaaaggtntacgaccaacgtaaggttaaacgtttcgagggggtaccgtaggggtaccaaccgacgtacggaacccggaacgggaacctaccgacctagtacgacgacaccggtccactacgacgacgaacacgtcccgtaanacgtacggactacggacggccggtcgacggaccgacgtaccgacgtaccggaacgaaccggtacgttacttacgttcgtcggtacggacgggtagg

SEQ ID NO: 402418 - DNA, 576 bp, Homo sapiens
  misc_feature: GZ8MTXP02JR56O.4.37.D04.1.454.CMB.2.raw
  modified_base (254)..(254): a, c, t, g, unknown or other
  modified_base (366)..(366): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctctgcaaggcttcnggatacaccttcaccgcctactatatgcacgtgggtgcgacgtcggcccctggacaagggcttggagtggagtgggatggactccggacctagaggcggtggcacgaaagtncgcacgtagaagttcgagggcaggtcacgatgacgaggacacgtaccatcagcacgtcactcacgacaccgagaccctacacgttacggaccgtaggaacggtccggtaccgtggaaccgtacgttaccggacgtaaccggaaccgtaacccggggtaaccgttagttaacgtttcggttacggtaggtaccgggtaaggggtaacgggg

SEQ ID NO: 402419 - DNA, 527 bp, Homo sapiens
  misc_feature: GZ8MTXP02JEKI0.4.37.D04.1.454.CMB.2.raw
  modified_base (249)..(249): a, c, t, g, unknown or other
  modified_base (281)..(281): a, c, t, g, unknown or other
  modified_base (355)..(355): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaggtctctgcaggctcngatacaccttcaccgctactatatgcagtggngcgacgtcggcccctggacgaggcttggagtggagtgggatggactccgacctacgaggcggtgacagaaagtntagacaagagtagttcgagggacgaggtaccacgtagacggacgacgggacacgtacatcgacgaccacgtaccagcacgaccacgaccgtaccacgagtcggacctggacggccggactcgacgagtcgacgaaccgtacgacgtcctagttcttcgagtcggacgtggag

SEQ ID NO: 402420 - DNA, 580 bp, Homo sapiens
  misc_feature: GZ8MTXP02JKVJQ.4.37.D04.1.454.CMB.2.raw
  modified_base (247)..(247): a, c, t, g, unknown or other
  modified_base (250)..(250): a, c, t, g, unknown or other
  modified_base (259)..(259): a, c, t, g, unknown or other
  modified_base (531)..(531): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccaggtgcagctggtgcagtcgtggggctgaggtgaagagcgtgggcctgagtgagtctctgcagctcgngancactcaccnctactatatgactacgtgggtcgccgacgtccggcccctagggaaccgaagggtcttggaggtggagtggggatggacctaccgacccgtaagacggtcggtacgacacgtaaagtgtacgacaacgaaggttacgttacgacggggcgtaacggtacaacgtagtacgaaccgacggggaccaccggtacagtacgaacgccctaacgtaccgatacgacgaccaacgtaccgacctacgacgtacgaccgaggaccgcggtcgacgacgngtcgacgacgacgacgtaacgtattacgttcggagaccgagggtagagg

SEQ ID NO: 402421 - DNA, 524 bp, Homo sapiens
  misc_feature: GZ8MTXP02GFJ3L.4.37.D04.1.454.CMB.2.raw
  modified_base (250)..(250): a, c, t, g, unknown or other
  modified_base (272)..(272): a, c, t, g, unknown or other
  modified_base (358)..(358): a, c, t, g, unknown or other
  modified_base (430)..(430): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgagtctcctgcaggcttcnggatcacctcaccgctactatntgcacgtggtgcgactcggcccctaggaccgaagggtcttggagtggagtgggatggactcgacctagaggcggtgacagaaagtntgacacgagtaaacgttcgagggacgacgggtcacgagtacgacgacgggacacgtcactcgagcacgtcancacgcacgacactacagtcggactgacggccgtcgacgacgtacgtcgacgaacgccgacgtcgtatactttcgacgtcgacgggaggtaacgg

SEQ ID NO: 402422 - DNA, 596 bp, Homo sapiens
  misc_feature: GZ8MTXP02H4FK4.4.37.D04.1.454.CMB.2.raw
  modified_base (228)..(228): a, c, t, g, unknown or other
  modified_base (377)..(377): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctnagtgaaggtctcctgcaaggcttctggactacaccttcaccgtcctactatatgcacgtgggtcgcgacgtccggcccctggaacgaagggtcttggaggtggagtggggatggactccgaccctaagaggcggtggacacgaaagttncggacaacgtagtaaagtttcgaggggtacgagggtaccaccgagtcgaaccgaggggaaccacggtccagtcgacgctaaccgtctacgacacgaccaaccgtacgacctacgacgtacggacctaggaacggccggcgtacggactacgtaccgtacgaaccgacgtaccggtaaccgttagttaactttcgtcggtacggtacgggtaagggaagg

SEQ ID NO: 402423 - DNA, 497 bp, Homo sapiens
  misc_feature: GZ8MTXP02IRO2J.4.37.D04.1.454.CMB.2.raw
  modified_base (337)..(337): a, c, t, g, unknown or other
  modified_base (352)..(352): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagagctggggcctcagtgaaggtctcctgcaaggcttctggatacaccttcaccgcctactatatgcactgggtgcgactggcccctggacaagggcttgagtggatgggatggatcgaccctaacngcggtgcacaaagtntgcaacagtaaagttcgagggcaggggtcacagtagaccagggacacgtccatcagcacgtccatcacgcacacgtcacagtcgacctggacgcggcctggaacacgtcgacgacgacgaacggcctatacttgcgtgcgaaggg

SEQ ID NO: 402424 - DNA, 561 bp, Homo sapiens
  misc_feature: GZ8MTXP02H8DOX.4.37.D04.1.454.CMB.2.raw
  modified_base (228)..(228): a, c, t, g, unknown or other
  modified_base (549)..(549): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctcctgcaaggcttctggataccaccttcaccgtcctactatatcgcacgtgggtcgcgacgtcggcccctggacaagggcttggagtggagtggggatggactccgaccctagaggcggtaggacacgaaagtatcgacaacgagtaagtttcgagggcgaggtacaccgagtacgaaccgacgggaaccacggtaccacgtacgacgcctaaccggtaccataccgaacgaccaaccgacgacctacgacgtcggaccgtggacggccggctacgacacgtcgacgacgtacgacgtcgtatacgttcgngtcgcgtaggag

SEQ ID NO: 402425 - DNA, 508 bp, Homo sapiens
  misc_feature: GZ8MTXP02JTF5A.4.37.D04.1.454.CMB.2.raw
  modified_base (251)..(251): a, c, t, g, unknown or other
  modified_base (357)..(357): a, c, t, g, unknown or other
  modified_base (494)..(494): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcacgtgggtgcgactcggcccctggacaagggcttgagtggagtgggatggactcgacctacagcggtggcacaaagtntgcacagtaagttcgagggcagggtcaccatgaccgagggacacgtccatcgagcacgtccatcacgcacgagcctacagtggacctggacgcgggctggacacgtcgtacgacgaccgacggccgtattacgttcnggtcgcggaggagg

SEQ ID NO: 402426 - DNA, 653 bp, Homo sapiens
  misc_feature: GZ8MTXP02JPYLC.4.37.D04.1.454.CMB.2.raw
  modified_base (255)..(255): a, c, t, g, unknown or other
  modified_base (348)..(348): a, c, t, g, unknown or other
  modified_base (366)..(366): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttcnggatacaccttcaccgctactatatgcacgtgggtgcgacgtcggcccctggaacagggtcttggagtggagtgggatggactcgacctaagnggcggtagcagaaacgtntcgacacgtagtaagtttcgagggtcgacgggtacaaccgagtacgaccgaacggggaacctaaccggttaccaacgtacgaaaccggtacctaacccgggttacccaattaccgaaacggacccaaacgaaccggtacccttaaaccgacggttaccggacccgtacgggaacggtcccgggaccgttacggacccgaaacggttaccgtaccgtaaaccggtaacccgaccggggtaaccgttaaccttagtttaccggtaggttacggacgggtaacgggtagg

SEQ ID NO: 402427 - DNA, 548 bp, Homo sapiens
  misc_feature: GZ8MTXP02JA438.4.37.D04.1.454.CMB.2.raw
  modified_base (247)..(247): a, c, t, g, unknown or other
  modified_base (284)..(284): a, c, t, g, unknown or other
  modified_base (343)..(343): a, c, t, g, unknown or other
  modified_base (362)..(362): a, c, t, g, unknown or other
  modified_base (428)..(428): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgaggcctcagtgaggtctccgtgcaggcttnggatacaccttcaccgctactatatgcacgtgggtcncgactcggcccctggacgagggtcttggagtggagtggggatcggatccgaccctaagnggcggtgcaacgaaagtanagccaagagtaagttcgagggtacgacgggtacaacgagtacgacccgaacgggacaccgtcctanacacggctaccgtccactacacgcacacgacctacacgtacggacctggacggccggactacggactacgacgtacgacgtaacgaacggtaccgtaattcgttcctgtcggacgaaggg

SEQ ID NO: 402428 - DNA, 504 bp, Homo sapiens
  misc_feature: GZ8MTXP02F8E6G.4.37.D04.1.454.CMB.2.raw
  modified_base (345)..(345): a, c, t, g, unknown or other
  modified_base (411)..(411): a, c, t, g, unknown or other
  modified_base (422)..(422): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttcgtggatacaccttcaccgcctactatatgcacgtggtgcgacgtcggcccctggacgaaggcttggagtggagtggatggactcgacctaanagcggtagacacgaaagtatagacacgaagaagttcgaggcaggtcacatgacgaggacacgtcancagcacgtcancagcacacgcctacagtacgacgtgacggccggctgacgagtcgacgacgtacgacgcgtagtacttcagtcgacgtaggag

SEQ ID NO: 402429 - DNA, 506 bp, Homo sapiens
  misc_feature: GZ8MTXP02JJYSZ.4.37.D04.1.454.CMB.2.raw
  modified_base (350)..(350): a, c, t, g, unknown or other
  modified_base (370)..(370): a, c, t, g, unknown or other
  modified_base (447)..(447): a, c, t, g, unknown or other
  modified_base (496)..(497): a, c, t, g, unknown or other
  modified_base (499)..(499): a, c, t, g, unknown or other
  modified_base (501)..(506): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggataccaccttcacccgcctactatatgcacgtgggtgcgacgtcggcccctggacgaagggcttggagtggagtgggatggactccgaccctaanaggcggtggacacgaaagtntagcaacgagtaagttcgagggcaggtcacatgacgagggacacgcatcagcacgtcatcacgacacgagacctacngtacggaccgtgacggcgggcgtcgggacgaacgggccgacgaacgagnngncnnnnnn

SEQ ID NO: 402430 - DNA, 541 bp, Homo sapiens
  misc_feature: GZ8MTXP02HJLVB.4.37.D04.1.454.CMB.2.raw
  modified_base (365)..(365): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttcgtggatacaccttcaccgcctactatatgcacgtgggtgcgactcggcccctggacaagggcttggagtggatgggatggactccgacctaacgaggcggtggcacgaaagtntgacactagaagtttcgagggcgaggtcacgatgaccgaggacacgtacatcagcacgtcacgtcacgacacgacgacctactacgtacggaccgtggaacggccggaccgtcggaccacgtaccgtacgacgacgaccgtaacgtacgtacgttcgtaggtacggacggaggagg

SEQ ID NO: 402431 - DNA, 577 bp, Homo sapiens
  misc_feature: GZ8MTXP02F1CYO.4.37.D04.1.454.CMB.2.raw
  modified_base (229)..(229): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaaggcttctggatacaccttcaccgcctactatatgcacgtgggtgcgactcggcccctggacaagggcttgagtggagtgggatggactccgaccctaagaggcggtcggacacgaaagtatggacacgtaaggtaacgtttcgaggggcgagggtccaacgatcgaccgagggacacgtccatcacgccacgtccatacacgacaaccgacgaccctagaacgtcggaacccgtggaacggtccggccgtagaccgtaacttccgacgaacccgacgaaccggtaaccgttaattacgtttccggtaggtcggacgggtaggggtaacgg

SEQ ID NO: 402432 - DNA, 490 bp, Homo sapiens
  misc_feature: GZ8MTXP02JKIH8.4.37.D04.1.454.CMB.2.raw
  modified_base (336)..(336): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccgcctactatatgcactgggtgcgactggcccctggacaaggcttgagtggatggatggactcgacctaangcggtggcacgaaagtatgacacagaagtttcagggtcagggtcacagtgacagggacacgtcatcagcacgtcatcagcacacgcctacatacggactgacgccggacgtgacgaatcgacgacgacgacgccgtatcttcagtgcgtaggag

SEQ ID NO: 402433 - DNA, 544 bp, Homo sapiens
  misc_feature: GZ8MTXP02HHVKZ.4.37.D04.1.454.CMB.2.raw
  modified_base (248)..(248): a, c, t, g, unknown or other
  modified_base (351)..(351): a, c, t, g, unknown or other
  modified_base (370)..(370): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctgagtgaggtctctgcaggtctgnggatacctaccttcaccgtcctactatatgacacgtgggtcgccgtacgtcggcccctggaacgagggtcttggaggtggagtgggatggactccgacctagnggcggtggacacgaaagtncgacaagagtaacgttcgagggtctacgggtacacgagtcgacgagggacacgtacatcgagccacgtccatcgagacacgacgaccagacgtcggaccgtggacggtccggcgtagacgtacgtccgtacgacgacgacgtccgttagtacgttcgagtcggacggaggtagg

SEQ ID NO: 402434 - DNA, 532 bp, Homo sapiens
  misc_feature: GZ8MTXP02JLQLQ.4.37.D04.1.454.CMB.2.raw
  modified_base (289)..(289): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtgggcctgagtgaggtctcctgcaaggcttcgtggatacaccttcaccgcctactatatgcacgtggtncgacgtcggcccctggacaagggcttgagtggagtggatggactccgacctaagaggtcggtgacacgaaagtgtgacaacgagtaacgttcgagggtcgaggtacacagtacgaccgaggacacgtacatcagccacgtaccatcaacgccaacacgacctacgacgtacggaccgtagacggccggccgtagaccgtagtcgacgacgacgacggtcgtatacttcgaggcgacggaggag

SEQ ID NO: 402435 - DNA, 501 bp, Homo sapiens
  misc_feature: GZ8MTXP02I43I5.4.37.D04.1.454.CMB.2.raw
  modified_base (339)..(339): a, c, t, g, unknown or other
  modified_base (355)..(355): a, c, t, g, unknown or other
  modified_base (439)..(439): a, c, t, g, unknown or other
  modified_base (483)..(483): a, c, t, g, unknown or other
  modified_base (491)..(491): a, c, t, g, unknown or other
  modified_base (500)..(500): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgactcggcccctggacgaaggtcttgagtgatggatggactcgacctanagcgtgcacgaaagtntgacacgagtaagtttcgaggacgagggtacaccgagtagaccgagggacacgtccagtcagcacgtcatcagacacagcctanacgtgactgacgcgctgacacgtacgtcgacgacgacgaacgtntacttcgngcgacgagng

SEQ ID NO: 402436 - DNA, 554 bp, Homo sapiens
  misc_feature: GZ8MTXP02FQ5BR.4.37.D04.1.454.CMB.2.raw
  modified_base (252)..(252): a, c, t, g, unknown or other
  modified_base (356)..(356): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctcctgcaggcttnggatacaccttcaccgtcctactatatgcacgtgggtgcgaccgtcggccccgtggaccgaagggtcttggaggttggagtgggatggactccgaaccctaagnggcggtagacacgaaagtatgaccaacgagtaacggtttacgagggcgaagggtacaaccagtcgaacgacgggaaccacgtcaagtcgagccaacgtacagtacacgacaacgtacgacctacgacgtcggaactgggaacgccggcgacggacgagccgagaaccgacgacggctatattcgagtcgacgaggagg

SEQ ID NO: 402437 - DNA, 517 bp, Homo sapiens
  misc_feature: GZ8MTXP02FR091.4.37.D04.1.454.CMB.2.raw
  modified_base (252)..(252): a, c, t, g, unknown or other
  modified_base (346)..(346): a, c, t, g, unknown or other
  modified_base (363)..(363): a, c, t, g, unknown or other
  modified_base (448)..(448): a, c, t, g, unknown or other
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaggtctcctgcaaggcttcnggatacaccttcacccgcctactatatgcacgtgggtgccgacgtcggcccctggacgaaggcttgagtggatgggatggactccgacctaagngcggtgacacgaaagtntcgacacgaagtacgtttcgagggcgaggtacacgagtacgaccgagggacacgtcatcgagcacgtcatacagcacacgcctanacgtcgactgacgccggctagacagtcgacgacgacgacggctagtacgttcgngtacgcggaggtagg

SEQ ID NO: 402438 - DNA, 535 bp, Homo sapiens
  misc_feature: GZ8MTXP02I38HK.4.37.D04.1.454.CMB.2.raw
  modified_base (253)..(253): a, c, t, g, unknown or other
  modified_base (270)..(270): a, c, t, g, unknown or other
  modified_base (280)..(280): a, c, t, g, unknown or other
  modified_base (349)..(349): a, c, t, g, unknown or other
  modified_base (520)..(520): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggacgcccactcccaggtgcagctggtgcagtcgtggggctgaggtgaagaacgccgtgggcctcgagtgaaggtctctgcaggcttngatcactcacgctatanatgcagtggngcgactcggccctggacgaggtctgagtggatggatgactccgaacctagagtcggtagacagaaagtnagacagtagtaggtttcgaggtcgaggtacacgagtacgaacgacgggacaccgtacacgtcacgacctacgtaccacgtcacgacaccgacgaccttacgacgtcgaccgtaggacggccggcgtacggacgtacgtcgacgaccgtacgtacggtaactcgtacttcgngtcggacggtagagg

SEQ ID NO: 402439 - DNA, 492 bp, Homo sapiens
  misc_feature: GZ8MTXP02ID9VW.4.37.D04.1.454.CMB.2.raw
  modified_base (338)..(338): a, c, t, g, unknown or other
  modified_base (356)..(356): a, c, t, g, unknown or other
  modified_base (386)..(386): a, c, t, g, unknown or other
  modified_base (479)..(479): a, c, t, g, unknown or other
  modified_base (484)..(484): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgctactatatgcacgtgggtgcgactcggcccctggacagggcttgagtggatggatggactcgacctaanagcggtggcacgaaagtngcacaggaagtttcgagggcagggtcacangaccgagggacacgtcatcgagcacgtccagtcagcacagcctacagtgacctgacgcggctgcagtctcgacgcgacggcctattacttcgngtcgngaggtagg

SEQ ID NO: 402440 - DNA, 594 bp, Homo sapiens
  misc_feature: GZ8MTXP02H0JWB.4.37.D04.1.454.CMB.2.raw
  modified_base (190)..(190): a, c, t, g, unknown or other
  modified_base (226)..(226): a, c, t, g, unknown or other
  modified_base (250)..(250): a, c, t, g, unknown or other
  modified_base (371)..(371): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggagcccactcccaggtgcagctggtncagtcgtggggctgaggtgaagagccgtggggcctnagtgaaggtctcctgcaggcttgngataccaccttcaccgctatatatcgcacgtgggtgcgacgtcggccccctggaacgaagggtcttggaggtggagtggggatggactaccgaccctagaggtcggtggacagtaaaagtntacggacaacgtaggtaagtttcggaaggggcgtacgggtacaacgagtaccggaaccgacggggaccaccggtccagtcgacgccacgtccagtccagaccaacgacgacctacgacgtacggactcggacggccggtctacggaacacggttacgcggaaaccgtacggacggtaaccgttacgtttaactttaccgggtaggtacggacgggtaagggtg

SEQ ID NO: 402441 - DNA, 539 bp, Homo sapiens
  misc_feature: GZ8MTXP02JFMA2.4.37.D04.1.454.CMB.2.raw
  modified_base (226)..(226): a, c, t, g, unknown or other
  modified_base (251)..(251): a, c, t, g, unknown or other
  modified_base (370)..(370): a, c, t, g, unknown or other
  modified_base (501)..(501): a, c, t, g, unknown or other
  modified_base (528)..(528): a, c, t, g, unknown or other
  modified_base (530)..(530): a, c, t, g, unknown or other
  modified_base (532)..(539): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagcgtggggcctnagtgaggtctcgtgcaggtcttcgnggactacaccttcaccgtcctactatatgacacgtggtcgcgacgtcggcccctggacgaagggcttgagtggagtggatggactaccgaccctaagaggcggtagacacgtaaagtanagacagagtaagtttcgacggggacaggtaccacgagtacgacgaggacacgtaccagtcacgccacgtaccagtaccagaccaacgacgaccctaacgacgtacggaacctgggaccgggcggtaccggnggaaccggaaacggccgacgaacgtgngngnnnnnnnn

SEQ ID NO: 402442 - DNA, 540 bp, Homo sapiens
  misc_feature: GZ8MTXP02FPTU3.4.37.D04.1.454.CMB.2.raw
  modified_base (465)..(465): a, c, t, g, unknown or other
  modified_base (472)..(472): a, c, t, g, unknown or other
  modified_base (539)..(539): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggataccaccttcaccgcctactatatgcacgtgggtgcgacgtcggccccgtggacgaaggggtcttggaggtggagtgggatggactccgaccctaagacggcggtggacacgaaatgtagacaagaaggtaacgtttcgaggggtcgaggggtaccaacgagtacgaaccgaggggacaccgtcagtcagccacgtccagtcagcacncgtccanacgtcggactggacgccggacctagacagtcgacgacgacgacggcgtatactgtggcgacggaggng

SEQ ID NO: 402443 - DNA, 552 bp, Homo sapiens
  misc_feature: GZ8MTXP02I72SJ.4.37.D04.1.454.CMB.2.raw
  modified_base (253)..(253): a, c, t, g, unknown or other
  modified_base (402)..(402): a, c, t, g, unknown or other
  modified_base (533)..(533): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaggtctctgcaaggcttcnggatacacctcaccgctactatatgcagtgggtcgcgactcggccccgtggacgaagggcttggagtggagtggatggactccgaccctagacggcggtggacacgaaagtactgacacgtaagtaacgttcgagggcagggtcacagngacgacggacacgtcagtcagcgaccgtcatccgagccaacacgtcctaacgactcgggacctgggacgccgggtcctaggactaacgtcgacgaaccggaccgtacggtaacccgttattacgtttacgnggtcggacggtagggaagg

SEQ ID NO: 402444 - DNA, 508 bp, Homo sapiens
  misc_feature: GZ8MTXP02GVCCK.4.37.D04.1.454.CMB.2.raw
  modified_base (253)..(253): a, c, t, g, unknown or other
  modified_base (288)..(288): a, c, t, g, unknown or other
  modified_base (356)..(356): a, c, t, g, unknown or other
  modified_base (497)..(497): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcnggatacacttcaccgtctactatatgcacgtgggngcgactcggcccctggacagggctgagtgagtgggatggactcgacctagagcggtgacacgaaagtngacacgagtaagttcgagggcagggtcaaccagtcgaccgacgggacaccgtacatacgagcacgtccatcagacaccgagacctacgagtcgactgacgcggacgagacacgcgtcgaacgacgacggcgtatacttcgngcgacgaggag

SEQ ID NO: 402445 - DNA, 611 bp, Homo sapiens
  misc_feature: GZ8MTXP02HDFUM.4.37.D04.1.454.CMB.2.raw
  modified_base (259)..(259): a, c, t, g, unknown or other
  modified_base (284)..(284): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgccccacctcccgaggtgcagctggtgcagtcgtggggctggaggtagaagaagccgtggggcctcgagtgaaggtctctgcaaggcttgnggatacaccttcaccgctactatangcagtgggtgcgacgtcggcccctaggacgaagggtcttggaggtggagtgggatggactccgaacctaacgaggcggtagacacgaaagtactcgacacgtaaggtacgtttacgagggtacgaggtaccacgagtacgaccgacgggaacaccggtccagtccgacgccgaccgtccagtaccacgaccaaccgacgacctacgtacgtacggaccgtcggaccggccggtaccgttacgaccgtacgtaccgtacggaacccgaccgtaccggtaaccgttacgttaccgtttcggtacggttacgggacgggtaaggtacggg

SEQ ID NO: 402446 - DNA, 519 bp, Homo sapiens
  misc_feature: GZ8MTXP02HG9AN.4.37.D04.1.454.CMB.2.raw
  modified_base (243)..(243): a, c, t, g, unknown or other
  modified_base (356)..(356): a, c, t, g, unknown or other
  modified_base (441)..(441): a, c, t, g, unknown or other
  modified_base (503)..(503): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctcagtgaggtctctgcaggctnggatacaccttcaccgcctactatatgcacgtgggtgcgactcggcccctggacaaggggcttggagtggagtgggatggactcgaccctaagaggcggtggacacgaaagtntgacaacgagaagtttcgagggcgagggtcaccgagtcgacgagggacacgtccatcagcacgtccatcagccacacgccaacgntacggacctggacgcgctggactacgtcacgacgacgaaccggtccgtaacttacgttacgngtcggacgggtaggag

SEQ ID NO: 402447 - DNA, 708 bp, Homo sapiens
  misc_feature: GZ8MTXP02HPYAW.4.37.D04.1.454.CMB.2.raw
  modified_base (259)..(259): a, c, t, g, unknown or other
  modified_base (417)..(417): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaaggaagccgtggggcctgagtgaaggtctcctgcgaaggtcttcgnggactacaccttcaccgtcctactatagtgctacgtgggtcgcgtaccgtcggaccccctggaaccgtaaggggtcttaggaggtggaagttggggattggggaccctaccggaaccccgtaacgacgggtcggtacgggacaaccgaaaaggtttanacgacctaacgaaaggttaaacgtttccgggaacgggggacgtaacgggggtcccaaacccggtaagtaccggaacccgaacgggggacctaacccgggtacccaaagtccgaacgaccgaccgtacactacgaccgacaccgtacgacccaagtacgcggtaccgacggaacggtccggccgttacggaaacctacgttcccgaacggtaccgtaacccggaccggggttaacccgtttaaattaccggttttcggaggtttaccggggacgggttacgggggaaagggg

SEQ ID NO: 402448 - DNA, 547 bp, Homo sapiens
  misc_feature: GZ8MTXP02JQIY7.4.37.D04.1.454.CMB.2.raw
  modified_base (226)..(226): a, c, t, g, unknown or other
  modified_base (250)..(250): a, c, t, g, unknown or other
  modified_base (363)..(363): a, c, t, g, unknown or other
  modified_base (453)..(453): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaggtctcctgcaaggcttcnggatacaccttcaccgcctactatatgcacgtgggtcgcgactcggcccctggacaagggcttggagtggagtgggatggactccgaccctaagagcggtggacacgaaagtntcgacacgagtaagtttcgagggcgtacgggtcaacgatacgaccgagggacacgtccatcacgcacgtcatcacgacacacgacctacncgtacggacctggaacggccggcgtacggaacctacgttcgacgaccgaccgaaccggtccgtaattcgttcgtggtcggacgggaggtaacgg

SEQ ID NO: 402449 - DNA, 569 bp, Homo sapiens
  misc_feature: GZ8MTXP02JC6J1.4.37.D04.1.454.CMB.2.raw
  modified_base (248)..(248): a, c, t, g, unknown or other
  modified_base (376)..(376): a, c, t, g, unknown or other
  modified_base (440)..(440): a, c, t, g, unknown or other
  modified_base (502)..(502): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctgagtgaggtctcctgcaaggcttntggatacaccttcaccgcctactatatgcacgtgggtcgcgtaccgtcggccccctggaccaaggggtcttggagtggagtggggattggactccgaaccctaacgaggcggtagacacgaaagttancgacaagagtaagtttcgaagggcgtacgggtccaacgagtacgacgacgggaccacggtcacncacgcacggtccagtccagaccacgcgacctacgacgcgaccgtgacgcggaccgtggaccncgttacacgaaccgaccgaccggtccttaagtttccgtttccgtaggtacggacggaggggtaacgg

SEQ ID NO: 402450 - DNA, 629 bp, Homo sapiens
  misc_feature: GZ8MTXP02GQMV2.4.37.D04.1.454.CMB.2.raw
  modified_base (254)..(254): a, c, t, g, unknown or other
  modified_base (368)..(368): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctcctgcaaggcttcnggatacaccttcaccgcctactatatgcacgtgggtgcgacgtcggcccctggacgagggcttggagtggagtggggatggactccgacctagacggcggtggacacgaaagtntaggacaacgtagtaacgtttcgaggggtcgtaggggtaccaacgagtacggaccgaagggggaacctaccggtacctaacgtccgaacggccgtaaccggttacccaattccgaacggaccaaccgacgtaccctaacgacgttacgggaaccgtcgggaacggtccgggtaccgtacggaccggtaacgttccggtacggaaccgtacggtacggtccggttaattacgtttacgggtggtacggacgggtagggtagg

SEQ ID NO: 402451 - DNA, 502 bp, Homo sapiens
  misc_feature: GZ8MTXP02I26A3.4.37.D04.1.454.CMB.2.raw
  modified_base (334)..(334): a, c, t, g, unknown or other
  modified_base (346)..(346): a, c, t, g, unknown or other
  modified_base (363)..(363): a, c, t, g, unknown or other
  modified_base (368)..(368): a, c, t, g, unknown or other
  modified_base (410)..(410): a, c, t, g, unknown or other
  modified_base (491)..(491): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccaggtgcagctggtgcagtcgtggggctgaggtgaagaagccgtggggcctcagtgaaggtctcctgcaaggcttctggatacaccttcaccgcctactatatgcacgtgggtgcgactcggcccctggacaagggcttggagtgagtgggatgacnccgaccctaagngcggtgacacaaagtangacanaagtagtttcgaggcgaggtcacatcgacgaggacacgccancagcacgcatcagaccacacgacctacagtcggacctggacgcggctaggacagtcgacgacgacgacgcgtatcgttcgngtcgcgaggag

SEQ ID NO: 402452 - DNA, 515 bp, Homo sapiens
  misc_feature: GZ8MTXP02GY300.4.37.D04.1.454.CMB.2.raw
  modified_base (337)..(337): a, c, t, g, unknown or other
  modified_base (353)..(353): a, c, t, g, unknown or other
  modified_base (422)..(422): a, c, t, g, unknown or other
  modified_base (503)..(503): a, c, t, g, unknown or other
  modified_base (514)..(514): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctcctgcaaggcttcgtggatacaccttcaccgcctactatatcgcacgtggtgcgactcggcccctggacaagggcttgagtggatggatggatcgacctangcgtggcacgaaagtngcacgagtagttcgagggcagggtcaccgagtacgacgagggacacggtacagtacgagcacgtccaanacacgacacgacgacctacacgtacgacgtgacggcggacgacgacgacgtacgacgacgacgtacgaacgtatacgtcgngtggacgaggng

SEQ ID NO: 402453 - DNA, 534 bp, Homo sapiens
  misc_feature: GZ8MTXP02JUQ4L.4.37.D04.1.454.CMB.2.raw
  modified_base (252)..(252): a, c, t, g, unknown or other
  modified_base (357)..(357): a, c, t, g, unknown or other
  modified_base (377)..(377): a, c, t, g, unknown or other
  modified_base (453)..(453): a, c, t, g, unknown or other
  modified_base (524)..(524): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggcctcagtgaaggtctcctgcaaggcttcnggatacaccttcacccgctactatatgcacgtgggtcgcgactcggccccctgggacgaaggggtctttaggaggttgggagtggggatggacctcgaccctaanaggcggtggacacgaaagtntgcaacgagtagtttcgaggggcacggggtcaccgatacggaccgagggacacgtaccatcgacgcaacgtcctancacgacacacgccacacgtcggacctgacgtcggcaggacacgcgtacgacgacgacggtcagttactcgngcgcgaggag

SEQ ID NO: 402454 - DNA, 574 bp, Homo sapiens
  misc_feature: GZ8MTXP02HWEYF.4.37.D04.1.454.CMB.2.raw
  modified_base (456)..(456): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagagcctgggcctcagtgaaggtctctgcaaggcttctggatacgaccttcaccgcctactatatgcacgtgggtgcgactcggcccctggacaagggctttggagtggagtgggatggactcccgaacccttaacgacggcgggttagaccaacgtaaagtgtacgaccaacgtaaaggtaacggtttcgaaggggctaacggggtaccaaccgtagtacggaacccgaggggaaccacggtcccaancgacgacaccgtcagtcacgcaacgacgacctacacgtcggacctagacgccggctagactacgtcgacgaccgacgaccggtactaattacgttaccgtcgtaggacgaggacgtgg

SEQ ID NO: 402455 - DNA, 516 bp, Homo sapiens
  misc_feature: GZ8MTXP02IS6I1.4.37.D04.1.454.CMB.2.raw
  modified_base (226)..(226): a, c, t, g, unknown or other
  modified_base (484)..(484): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccgcctactatatgcacgtggtgcgactcggcccctggacaagggcttggagtggatgggatggactcgaccctaacgaggcggtggacacgaaagtatgaccacgagtaaagtttcgaggggtcaggggtcaaccgatacgaccgacggggacacggtccaagtcagcaccgtacagtacagacacacgactacatcggacctgacgcgctagacatcncgacacgacgcgtactacttctgtgcgaggag

SEQ ID NO: 402456 - DNA, 535 bp, Homo sapiens
  misc_feature: GZ8MTXP02H7XI7.4.37.D04.1.454.CMB.2.raw
  modified_base (382)..(382): a, c, t, g, unknown or other
tcagagcactgtagcacgaccggtgctcgattttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaacgccgtggggcctcgagtgaaggttctcctgcaggtcttctggatacctaccttcacccgtcctactatatgcagtggtcgcgactcggccccgtggacgaagggtcttggagtggagtgggatggactccgacctaagcggcggtggacagaaagtatcgcaanagtaagtttcgaggtgacggtcacagtacgacgacgggacacgcatcagaccacgtcatcacgacacacactacgacgttcgacgtagaacggccggacgtgaccagtacgtacgacgtcgacggtcgtatacgttcgtgtacgagaggtagg

SEQ ID NO: 402457 - DNA, 540 bp, Homo sapiens
  misc_feature: GZ8MTXP02JEJJI.4.37.D04.1.454.CMB.2.raw
  modified_base (226)..(226): a, c, t, g, unknown or other
  modified_base (246)..(246): a, c, t, g, unknown or other
  modified_base (275)..(275): a, c, t, g, unknown or other
  modified_base (333)..(333): a, c, t, g, unknown or other
  modified_base (352)..(352): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtgggcctnagtgaggtctctgcaggctngatcactcaccgctactatatgcagtggngcgacgtcggcccctggacgaagggcttggagtggagtgggatggactcgacctaagnggcggtagacacgaaagtntacgacacgaagtaagttcgagggacgagggtacaccgatacgacgacggaacacgtacatcaacggccaaccgtaccaatccgacgccaacgacgacctaacgacgtacggacctaggacgccgggactaggacagtacgacgaaccgacgaccggtaactagtacttcgagtcggacggaggtagg

SEQ ID NO: 402458 - DNA, 516 bp, Homo sapiens
  misc_feature: GZ8MTXP02HKQ2V.4.37.D04.1.454.CMB.2.raw
  modified_base (253)..(253): a, c, t, g, unknown or other
  modified_base (340)..(340): a, c, t, g, unknown or other
  modified_base (359)..(359): a, c, t, g, unknown or other
  modified_base (496)..(496): a, c, t, g, unknown or other
  modified_base (507)..(507): a, c, t, g, unknown or other
  modified_base (515)..(515): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcnggatacaccttcaccgcctactatatgcagtgggtgcgactcggcccctggacaggcttgagtggagtggatggactcgacctaagnggcggtgacacaaagttangcaacgagtaacgtttcgaggggacagggtcaccagtacgacgagggacacgtccatcagccacgtctacacgagaccacacgacctacacgtcggacctggacggccggacgcggacaacggcgacgacgagccgngtactcgttcngcgcgagng

SEQ ID NO: 402459 - DNA, 523 bp, Homo sapiens
  misc_feature: GZ8MTXP02JBQ2I.4.37.D04.1.454.CMB.2.raw
  modified_base (482)..(482): a, c, t, g, unknown or other
  modified_base (514)..(514): a, c, t, g, unknown or other
  modified_base (522)..(522): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgtggatacaccttcaccgcctactatatgcacgtgggtcgcgactcggccccctggacgaagggcttggagtgggatggggatggactcggacccctaagaggcggtaggcacgaaagtagtcgacaacgaggaagtttcgagggacgaggtcaccgatcgaccgaggggacacgtaccatcagcacgtccagtcagaccacgacgcctacagtcgactggacgcggtcgnggacagacgcgacgacgcgccgatacgttcgngcgcgagng

SEQ ID NO: 402460 - DNA, 530 bp, Homo sapiens
  misc_feature: GZ8MTXP02JH2BS.4.37.D04.1.454.CMB.2.raw
  modified_base (240)..(240): a, c, t, g, unknown or other
  modified_base (247)..(247): a, c, t, g, unknown or other
  modified_base (254)..(254): a, c, t, g, unknown or other
  modified_base (368)..(368): a, c, t, g, unknown or other
  modified_base (404)..(404): a, c, t, g, unknown or other
  modified_base (428)..(428): a, c, t, g, unknown or other
  modified_base (514)..(514): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctcngcagctnggatacnccttcaccgcctactatatgcacgtgggtcgcgacgtcggcccctggaacgaagggtcttaggaggtggagtggggatggatccccgaaccctagagcggtggacaacgaagtntgacaacgagtaaggtttcgagggcgagggtacacngtacgaacccgaggacacgtacancagcaccgtacatcacgacacacgacctacacgtcgactggacgtcggactgacatcgacgaccgacgacgtacgtaatacttcgngtagcgagggagtagg

SEQ ID NO: 402461 - DNA, 513 bp, Homo sapiens
  misc_feature: GZ8MTXP02JRGEN.4.37.D04.1.454.CMB.2.raw
  modified_base (197)..(197): a, c, t, g, unknown or other
  modified_base (245)..(245): a, c, t, g, unknown or other
  modified_base (338)..(338): a, c, t, g, unknown or other
  modified_base (353)..(353): a, c, t, g, unknown or other
  modified_base (359)..(359): a, c, t, g, unknown or other
  modified_base (409)..(409): a, c, t, g, unknown or other
  modified_base (498)..(498): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctgaggtgaagagcgtgggcctcagtgaggtctctgcagcttcnggatacaccttcaccgtcctactatatgcagtggtgcgacgtcggcccctggacgaaggcgttgagtggagtggagtggactccgacctaagngcggtgcacaaagtncgacanaggtaagtttcgagggacgaggtacacgatagacgaggaccacgtccgancgacgcaccggtacatcgacgaccacgacgacctacgagtcgacgtagacgcggctcgacagcctacgacacgacgtcgtatacttcgngcggtacggagtagg

SEQ ID NO: 402462 - DNA, 535 bp, Homo sapiens
  misc_feature: GZ8MTXP02IYLU5.4.37.D04.1.454.CMB.2.raw
  modified_base (524)..(524): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaggtctctgcaaggctctggatacaccttcaccgcctactatatgcacgtgggtgcgacgtcggcccctggacgaagggtcttggagtggagtggggatggactccgacctaacgacgcggtggacacgaaacgtatgaccaacgaaggtaaacgtttcgaggggcgaggggtcaaccgagtcgaaccgacggggacaccgtccatcacgcaccgtcccatccagacacgacgcctacactcggacctggacgcggctacggacacgtcgacgacgacgacgcgtatattcgngtcgcgaggag

SEQ ID NO: 402463 - DNA, 531 bp, Homo sapiens
  misc_feature: GZ8MTXP02HDFXQ.4.37.D04.1.454.CMB.2.raw
  modified_base (254)..(254): a, c, t, g, unknown or other
  modified_base (353)..(353): a, c, t, g, unknown or other
  modified_base (371)..(371): a, c, t, g, unknown or other
  modified_base (438)..(438): a, c, t, g, unknown or other
  modified_base (517)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctgagtgaaggtctcctgcaaggcttcgnggataccaccttcacccgtcctactatatcgcacgtgggtcgcgactcggcccctggaacaagggtcttggagtggagtgggatggactcgacctaagnggcggtgacagaaagtangacagagtagttcgagggcgaggtacacgagtcgacgagggacacgtaccatacagccaacgctacncacgacaacgacgacctacgagtcgacgtgaccgtcggcctaggacagtacgacgacgacgacgccgttatacgttcgngtcgacggtagagg

SEQ ID NO: 402464 - DNA, 589 bp, Homo sapiens
  misc_feature: GZ8MTXP02HQA27.4.37.D04.1.454.CMB.2.raw
  modified_base (242)..(242): a, c, t, g, unknown or other
  modified_base (253)..(253): a, c, t, g, unknown or other
  modified_base (370)..(370): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcgagtgaaggtctccngcaaggcttcnggatacaccttcaccgcctactatatgcacgtgggtgcgactcggcccctggacgaagggtcttggagtggagtgggatggactcgaaccctaagaggtcggtgacactaaagtagngacgagaggtaagttcgagggcgaggtactaacgtagtacgaccgacggacaccgtacacgtacgacgacctacgtaccatacgacgacctaaccgacgtacctaacgacgtaccggaccgtagggaccggccggtacgtacggaaccgacggtaccgtacgaaccggtaacgtaccggtaacgttacgttacgttcgaggtacggacggtagggtagg

SEQ ID NO: 402465 - DNA, 536 bp, Homo sapiens
  misc_feature: GZ8MTXP02JVB9I.4.37.D04.1.454.CMB.2.raw
  modified_base (252)..(252): a, c, t, g, unknown or other
  modified_base (525)..(525): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctctgcaaggcttcnggatacaccttcaccgacctactatatgcagtggtgcgacgtcggccccgtggacgagggcttggaggtggagtggggatggactccgacctacgacggcggtggacacgaaagtactggacaagagtaagttcgagggcagggtccacgatcgacgaggacacgtacatcgagccacgtccatccagaccaccgacgtacctacgacgtacggaccgtgacggccgggtcacgggactacgtcacgacgacgacggtcctagtacttgacgngacggaggtag

SEQ ID NO: 402466 - DNA, 534 bp, Homo sapiens
  misc_feature: GZ8MTXP02HII2C.4.37.D04.1.454.CMB.2.raw
  modified_base (244)..(244): a, c, t, g, unknown or other
  modified_base (342)..(342): a, c, t, g, unknown or other
  modified_base (527)..(527): a, c, t, g, unknown or other
  modified_base (533)..(533): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggatgatcctcttcttggtggcagcagccacaggagcccactcccaggtgcagctggtgcagtcgtgggctgaggtgaagagctgggctcagtgagtctctgcaggcttcgngatacacctcaccgctactatatcgcacgtgggtgcgtacgtcggccccgtaggacgaagggtcttgaggtggagtgggatggactccgaacctaagngtcggtagcaacaaagtatagacaacaaggtacgtttcgagggcgaacgggtcaaccgatacggaccgagggaccacgtaccatacgagccaccgtacacgacacgacaccacgacctaacgacgtacggacgcggacggtccggacgtacgaagaccgtcgacgaacgacgaacgctatgtcgngcgagng

SEQ ID NO: 402467 - DNA, 504 bp, Homo sapiens
  misc_feature: GZ8MTXP02FPNA1.4.37.D04.1.454.CMB.2.raw
  modified_base (228)..(228): a, c, t, g, unknown or other
  modified_base (255)..(255): a, c, t, g, unknown or other
  modified_base (348)..(348): a, c, t, g, unknown or other
  modified_base (373)..(373): a, c, t, g, unknown or other
  modified_base (492)..(492): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctnagtgaaggtctccgtgcaaggtcttcnggatacaccttcacccgcctactatatgcactaggtgcgactggcccctggacaagggcttggagtggagtgggatggactccgaccctaagnggcggtgacacgaaagtatgaccanagtaagttcgagggcagggtcacgatcgaccgagggacacgtcatcagcacgtccatcagacacacgcctacagtcggactgacgcgctgacagtcacgacgacgacgcgtatacttcngtgcggaggtag

SEQ ID NO: 402468 - DNA, 491 bp, Homo sapiens
  misc_feature: GZ8MTXP02FUS7T.4.37.D04.1.454.CMB.2.raw
  modified_base (286)..(286): a, c, t, g, unknown or other
  modified_base (336)..(336): a, c, t, g, unknown or other
  modified_base (389)..(389): a, c, t, g, unknown or other
  modified_base (420)..(420): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactggtncgactggcccctggcaggggctgagtggatgggatggactcgaccctaanagcggtgacacaaagtatgacacaagaaagtttcaagggctagggcaaccaanagacgacggacgacgacacacagacacacanacacacacacacacacagacgagacgcgcgagacagacgacgacgacgacgaacgatactctgtgcgagag

SEQ ID NO: 402469 - DNA, 528 bp, Homo sapiens
  misc_feature: GZ8MTXP02H5X3Q.4.37.D04.1.454.CMB.2.raw
  modified_base (195)..(195): a, c, t, g, unknown or other
  modified_base (282)..(282): a, c, t, g, unknown or other
  modified_base (321)..(321): a, c, t, g, unknown or other
  modified_base (349)..(349): a, c, t, g, unknown or other
  modified_base (352)..(352): a, c, t, g, unknown or other
  modified_base (354)..(354): a, c, t, g, unknown or other
  modified_base (392)..(392): a, c, t, g, unknown or other
tcagagcactgtagcacgaccggtgctcgatttagtagcatactgttgggttggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctgaggtgaagaagcgtgggcctcgagtgaaggtctctgcaaggcttctggatacacttcaccgcctactatatgcactggtncgactggcccctggacaaggcttgagtggatggatggancgaaccctagagcgtggcacaaaggtangananagtagttcgagcgagacacgagcgacgacgacacgcanacgacgcacgtacactacgacgacaacgtacgactacgacgtacggaccgtacgacggtcggacgtacgaacgtacgtacgtacgaacgtaacgacggtaacgtacgtacgttcgtacgtacgtacggacggacgg

SEQ ID NO: 402470 - DNA, 559 bp, Homo sapiens
  misc_feature: GZ8MTXP02F5F3F.4.37.D04.1.454.CMB.2.raw
  modified_base (296)..(296): a, c, t, g, unknown or other
  modified_base (373)..(373): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctgagtgaaggtctcctgcaaggtcttcgtggactaccaccttcacccgcctactatatgacacgtgggngcgactcggcccctggacgaagggtcttgaggtggagtgggatggactccgaccctaagaggcggtgacacaaagtntgacaagagtaacgttcgagggcagggtcaacagtacgacgacggacacgtcatacgagaccgacgtcgatacgacgacaaccgcgacctacagtcgaccgtggaacgccggtacctaggactacgtacgcgaaaccgacgacgtaaccgttaactacgtttacgtggtacggtacggagggtagg

SEQ ID NO: 402471 - DNA, 537 bp, Homo sapiens
  misc_feature: GZ8MTXP02IXRCI.4.37.D04.1.454.CMB.2.raw
  modified_base (225)..(225): a, c, t, g, unknown or other
  modified_base (248)..(248): a, c, t, g, unknown or other
  modified_base (280)..(280): a, c, t, g, unknown or other
  modified_base (308)..(308): a, c, t, g, unknown or other
  modified_base (356)..(356): a, c, t, g, unknown or other
  modified_base (482)..(482): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctnagtgaggtctctgcaggtcttgngatacaccttcaccgcctatatatgcagtggngcgactcggcccctggacaagggcttgngtggagtgggatggactccgaccctaagaggtcggtggcacgaaagtntcgacacgaggtaacgtttcgaggggacgtaacggggtcaaccgagtacgaccgacggggaccacgtaccagtcacgcaccgtccatcagacacacgacctacacgtcgaccgtgacgcgggaccngacgacgtacgacgacgacgacgtaacgttacttacttcgaggtcgacggaggag

SEQ ID NO: 402472 - DNA, 492 bp, Homo sapiens
  misc_feature: GZ8MTXP02FGEPV.4.37.D04.1.454.CMB.2.raw
  modified_base (288)..(288): a, c, t, g, unknown or other
  modified_base (365)..(365): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacccgcctactatatgcactgggtncgactggcccctggacaaggggcttgagtggatggggatggactcgaccctaagagcggtggcacaaagtatgacanagaagtttcagggcagggtcacatgaccagggacacgtcatcagcacgtcatcagcacagacctacatggacctgacgcggcctgacatctacgacgacgacgccgtatacttctgtgacggaggag

SEQ ID NO: 402473 - DNA, 548 bp, Homo sapiens
  misc_feature: GZ8MTXP02I2LD8.4.37.D04.1.454.CMB.2.raw
  modified_base (236)..(236): a, c, t, g, unknown or other
  modified_base (245)..(245): a, c, t, g, unknown or other
  modified_base (333)..(333): a, c, t, g, unknown or other
  modified_base (351)..(351): a, c, t, g, unknown or other
  modified_base (443)..(443): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctggaggtgaagagccgtgggcctgagtgagtcnctgcagctngatacacctcaccgcctatatatgcagtgggtcgcgactggcccctggacaagggtcttgagtgggatgggatggacctcgaccgtanaggcgtagacacaaagtnagacactagaaggttcaggggcagggtacacgacgtgaccgcgggaaccacgtccacgtacgacgtcaaccgtccaagccaacgacacgacncctaacgcttggacctcgggactcgggaccctaggaccctacgtaccgacggaaccgtaccgacggtccgttattacgttcgtggtacggcggtaaaggggtcgg

SEQ ID NO: 402474 - DNA, 607 bp, Homo sapiens
  misc_feature: GZ8MTXP02F6A43.4.37.D04.1.454.CMB.2.raw
  modified_base (245)..(245): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcgtgggcctcagtgagtctctgcaggcttntggatacaccttcaccgctactatatgcacgtgggtgcgacgtcggccccctggacgaagggtccttggacggtggaagtggggaatggactccggaccctaagacggcggtacggacacgaaagtactcgaccaacgaagtaacgtttcgagggacgacggggtacaaccgatcggaacccgagggacaaccggtccaacgtcaacggcctaaccggttaccactacgaacggaccaaccgtacgaccttaacgacgttacgggaacccgtacgggaacggtccgggtaccgtacggtacaaacggtcgtaccgaacgaccgtaacggccgttattacgttactaggtcgacggagggagg

SEQ ID NO: 402475 - DNA, 555 bp, Homo sapiens
  misc_feature: GZ8MTXP02I28VY.4.37.D04.1.454.CMB.2.raw
  modified_base (230)..(230): a, c, t, g, unknown or other
  modified_base (353)..(353): a, c, t, g, unknown or other
  modified_base (373)..(373): a, c, t, g, unknown or other
tcagagcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaggtctcctgcaggcttcgtggataccaccttcacccgtcctactatatgcacgtgggtgcgactcggcccctggacgaagggtcttggagtggagtgggatggactccgaacctacgnggtcggtggacacgaaagtntaggccaagagtagtttcgaagggcgacggtcacgagtacgaaccgagggacacgtaccatcacgcaccgtcatcgagaccacgtcgacctagactcggacctggacgacggtcgtacgacgtacgtcgtacgaccgaccgacgtaacgttactacgtttacgcggtacgacggtaggtagg

SEQ ID NO: 402476 - DNA, 556 bp, Homo sapiens
  misc_feature: GZ8MTXP02H0382.4.37.D04.1.454.CMB.2.raw
  modified_base (256)..(256): a, c, t, g, unknown or other
  modified_base (390)..(390): a, c, t, g, unknown or other
  modified_base (457)..(457): a, c, t, g, unknown or other
  modified_base (503)..(503): a, c, t, g, unknown or other
  modified_base (516)..(516): a, c, t, g, unknown or other
  modified_base (541)..(541): a, c, t, g, unknown or other
  modified_base (547)..(547): a, c, t, g, unknown or other
  modified_base (555)..(555): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcgaggctcgnggataccacctcaccgcctactatatgcagtgggtcgcgacgtccggcccctggaaccgaagggtcttaggaggtggaagtggggatggacctaccgaaccctaagaggtccggtaggaccaagtaaaaggttnacggacaaacaggtaaacgtttcgaggggcgagggtcaaccgagacgacgacgggacacgtaccganacgacgacacgtccagcacgcaacgacgacctacgagtcggaccgngaacgccggtacngacagccgacgaacgcgacgcgtanacttgngcgcgagng

SEQ ID NO: 402477 - DNA, 589 bp, Homo sapiens
  misc_feature: GZ8MTXP02H8X7B.4.37.D04.1.454.CMB.2.raw
  modified_base (291)..(291): a, c, t, g, unknown or other
  modified_base (498)..(498): a, c, t, g, unknown or other
  modified_base (508)..(508): a, c, t, g, unknown or other
  modified_base (521)..(521): a, c, t, g, unknown or other
  modified_base (587)..(587): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcaccagccacaggagcccactcccaggtgcagctggtgcagtctgggctgaggtgaagaagctggggcctcagtgaaggtctcctgcaaggtcttctggataccacccttcacccgacctactatatgcacgttgggngcgacgtcggcccctaggacgaagggtcttggaggttggagtggggaagtggactccccggaaccctaacgtcgcgggtacggacaacgtaagtatacgaccaacgtaagtaacgtttcgagggaccgtaggggaccaccgagtacggaccgacgggacacgtaccactcgacgaccacgtacccagacacgacacacgtaccaacngacggtaccnggacggccgtacngacactcgacgaccgaacgtacggacccgtttaagtcgttacgtggtacgacgggaggttaagggngg

SEQ ID NO: 402478 - DNA, 554 bp, Homo sapiens
  misc_feature: GZ8MTXP02IAXQ6.4.37.D04.1.454.CMB.2.raw
  modified_base (289)..(289): a, c, t, g, unknown or other
  modified_base (320)..(320): a, c, t, g, unknown or other
  modified_base (346)..(346): a, c, t, g, unknown or other
  modified_base (362)..(362): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttctggatacaccttcaccgcctactatatgcacgtgggngcgactggccccctggacaagggcttggagnggagtgggatggactcgaccctaagngcggtgcacgaaagtntgcacagaacgtttcagggtcaggtacacatgaccgacggggacacgtacactcacgccacgtcccataccgagaccacgacgacctacagtcggaactcggacggtcggccgtcggaccgtagtaccgtacgaccgaccgacggtccggtactttaacgttttccgagttaccggacgggtacggggaagg

SEQ ID NO: 402479 - DNA, 529 bp, Homo sapiens
  misc_feature: GZ8MTXP02H03D8.4.37.D04.1.454.CMB.2.raw
  modified_base (251)..(251): a, c, t, g, unknown or other
  modified_base (473)..(473): a, c, t, g, unknown or other
  modified_base (482)..(482): a, c, t, g, unknown or other
  modified_base (497)..(497): a, c, t, g, unknown or other
  modified_base (513)..(513): a, c, t, g, unknown or other
  modified_base (517)..(517): a, c, t, g, unknown or other
  modified_base (520)..(520): a, c, t, g, unknown or other
  modified_base (524)..(524): a, c, t, g, unknown or other
  modified_base (528)..(528): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctgagtgaggtctcctgcaggcttcgnggataccaccttcacccgcctactatatgcagtgggtgcgacgtcggcccctaggacgaagggtcttggaggtggagtggggactggactccgaacccctaagaggcggtaggaccacgtaaaaggtatcgaccaacgtaggtaaagtttcgaggggtacaggggccacagtcgaacgagggacacgtcagcgacgcacgtccagcacgcactacgacctanagtcggacnggacgtcggctgacncgtcgacgacagcgtntctntcngcgngagng

SEQ ID NO: 402480 - DNA, 523 bp, Homo sapiens
  misc_feature: GZ8MTXP02JUJ07.4.37.D04.1.454.CMB.2.raw
  modified_base (197)..(197): a, c, t, g, unknown or other
  modified_base (250)..(250): a, c, t, g, unknown or other
  modified_base (352)..(352): a, c, t, g, unknown or other
  modified_base (364)..(364): a, c, t, g, unknown or other
  modified_base (510)..(510): a, c, t, g, unknown or other
  modified_base (522)..(522): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctggaggtgaagaagccgtggggcctcgagtgaaggtctctgcaggctnggatacacctcaccgcctactatatgcagtggtgcgacgtcggcccctggacgaacgggtcttggaggtggagtgggatggactaccgacctaagaggcggngacacgaaagtntcgacacgagtaagttcgagggcgaggtcacgagacgacgaggacacgtcatcagcacgtcaactcgacgcacgacgacctacgacgtcgacgtggacgccgcgtacgacacgtcgacgacctacgacgtaacgtactacgttcgngtcggcggaggng

SEQ ID NO: 402481 - DNA, 492 bp, Homo sapiens
  misc_feature: GZ8MTXP02FOSUZ.4.37.D04.1.454.CMB.2.raw
  modified_base (337)..(337): a, c, t, g, unknown or other
  modified_base (430)..(430): a, c, t, g, unknown or other
  modified_base (454)..(454): a, c, t, g, unknown or other
  modified_base (487)..(487): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaataagcctggggcctcagtgaaggtctcctgcaaggcttctggatacaccttcaccgcctactatatgcactgggtgcgactggcccctggacaagggcttgagtggatgggatggatcgacctaanagcggtggacacaaagtatgcacagaagtttcagggcaggggtcaccatgaccgagggacacgtccatcagcacgtccatcagcacagcctanatggactgagcggctggacagtcncgacgacgacggcgtatacttctagtcgacggnggaag

SEQ ID NO: 402482 - DNA, 539 bp, Homo sapiens
  misc_feature: GZ8MTXP02GGW78.4.37.D04.1.454.CMB.2.raw
  modified_base (228)..(228): a, c, t, g, unknown or other
  modified_base (253)..(253): a, c, t, g, unknown or other
  modified_base (291)..(291): a, c, t, g, unknown or other
  modified_base (322)..(322): a, c, t, g, unknown or other
  modified_base (343)..(343): a, c, t, g, unknown or other
  modified_base (361)..(361): a, c, t, g, unknown or other
  modified_base (409)..(409): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctnagtgaaggtctcctgcaaggcttcnggatacaccttcacccgcctactatatgcacgtgggtncgactggcccctggacaggcttggagtggangggatggatccgaccctaagngcggtgcacgaaagtagngacagaagtagttcgaggcgaggcacagacgacgacggactacgtcancagacctacgcacacgacacacacgacctacacgtacgacgtacgacggaccggaccgtacgacacgtcgtacgaccggaaccgaccggtaaccgttacgttactttcgtagtacggacggacgggaagg

SEQ ID NO: 402483 - DNA, 549 bp, Homo sapiens
  misc_feature: GZ8MTXP02IK0RS.4.37.D04.1.454.CMB.2.raw
  modified_base (226)..(226): a, c, t, g, unknown or other
  modified_base (238)..(238): a, c, t, g, unknown or other
  modified_base (287)..(287): a, c, t, g, unknown or other
  modified_base (348)..(348): a, c, t, g, unknown or other
  modified_base (368)..(368): a, c, t, g, unknown or other
  modified_base (405)..(405): a, c, t, g, unknown or other
  modified_base (482)..(482): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagtctggtgcagtctggggctgaggtgaagtagcgtgggcctnagttgaaggtcnctgcaaggtcttctggatacacttcaccgctactatatgctactgggcncgactcggcccctaggacgaggtcttggaagtggatgggatggtactaccgacctaaacgnggcggtggacacgtaaagtntgacacgagtagtttccgaggtgagggtcaaccgtancgaaccggagggacctaacgtccaagtacaggtccaacgtaccatacacgacacgacgtacctacagtacgtaccgngaaccggtcgaacccgngactacgacgacgaccgagaccgtaatatacgttcgagtcgacggaggag

SEQ ID NO: 402484 - DNA, 567 bp, Homo sapiens
  misc_feature: GZ8MTXP02HGFUK.4.37.D04.1.454.CMB.2.raw
  modified_base (377)..(377): a, c, t, g, unknown or other
  modified_base (473)..(473): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgagtgaggtctcctgcaaggtcttctggatacaccttcaccgtcctactatatgacctacgtgggtcgcgacgtcgggccccgtaggacgaagggtcttggaggtggagtgggatggactcgaccctagagtcggtagacacgaaagtngacacgaaggtacgttcggagggcgtacggtcaaccgtatacggaaccgagggaccacgtaccatcgagcctacgccatcagcacacgactaacgngtacggactggacgccggactacggacacgttcgacggaccgtaccggtacgtcgttaacgtttcgttcggaggtcggacgggtagggtaacgg

SEQ ID NO: 402485 - DNA, 565 bp, Homo sapiens
  misc_feature: GZ8MTXP02I9UNK.4.37.D04.1.454.CMB.2.raw
  modified_base (253)..(253): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtggggctgagggtgaagaagccgtggggcctcgagtgaaggtctctgcaggctngatacacctcaccgctatatatcgcacgtggtgccgacgtcggcccctggaacgagggtcttggagtggagtggatggactccgacctaagcggcggtgacacgtaaagtcgtagacctaacgtaaggtaacgtttcggaaggggtacgaacgggtacacgagtacgacgacggacacgtacagtcgagaccacgtacctatcgagtaccacgacgacctacgacgtcggaccgtagacgacggtccgtagactacgtccgacgaccgacgtacggtaactacgttacgttcgtaggtacggaggaggtagg

SEQ ID NO: 402486 - DNA, 559 bp, Homo sapiens
  misc_feature: GZ8MTXP02HO86R.4.37.D04.1.454.CMB.2.raw
  modified_base (251)..(251): a, c, t, g, unknown or other
  modified_base (258)..(258): a, c, t, g, unknown or other
  modified_base (288)..(288): a, c, t, g, unknown or other
  modified_base (373)..(373): a, c, t, g, unknown or other
  modified_base (470)..(470): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcagtggggcctgagtgaaggtctcctgcaggcttcnggatacncttcaccgctactatatgcacgtggggtcncgacgtcggcccctagggacgaagggtcttggaggtggagtggggatcggactccgaacctagaggccggtggcaaacgaaagtncgacagagtagttcgaggcgtagggcaccagtacgaaccgagggaccacgtacactcgagtcacgtcatcgacgcaactacgctacgagtacgacgnggacgcggtcctaggacctaacgttcgacggaacccgacggtaacccgggtaaacttgttacgttttaccggacggtacggacgggagg

SEQ ID NO: 402487 - DNA, 511 bp, Homo sapiens
  misc_feature: GZ8MTXP02FQ1EU.4.37.D04.1.454.CMB.2.raw
  modified_base (226)..(226): a, c, t, g, unknown or other
  modified_base (252)..(252): a, c, t, g, unknown or other
  modified_base (342)..(342): a, c, t, g, unknown or other
  modified_base (344)..(344): a, c, t, g, unknown or other
  modified_base (357)..(357): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaaggtctcctgcaaggtcttcnggatacaccttcaccgcctaactatatgcacgtgggtcgcgacgtcggcccctggacgaggtctggagtggagtggatggactcgaccangnggagcagaaagtnagcacgagtagttcgaggcaggtcacgagtcgaaccgaggacacgtaccatcacgcacgtacatacagcaacgacgacctacacgcggaacctggaacgccggactacggactagtcacggacacgacgccgtatgttacgngacgacggagag

SEQ ID NO: 402488 - DNA, 633 bp, Homo sapiens
  misc_feature: GZ8MTXP02FUSZ5.4.37.D04.1.454.CMB.2.raw
  modified_base (255)..(255): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggtcttcgngatacaccttcaccgcctactatatgcacgtgggtgcgactcggcccctggacgaagggcttggagtggagtggggatggactccgaaccctaagaggcgggtaggactaacgaaagtactagacaacgaaggtaagtttcgaaggggtcgaaggggtaccaaccgagtacgaaccgaacgggacgtaaccgtaccaacgtcgaacggacccaacggtaccaacgtaccgaacgaccaaaccaacggaccccttaacgaacgttacgggaacccgtaggaaccgggtccggacccgtaggaacctaacgtacgtacgaaaccgaccggaacggtaaccgttaattaccgtttacggacggtacggacggaagggtacg

SEQ ID NO: 402489 - DNA, 568 bp, Homo sapiens
  misc_feature: GZ8MTXP02JVXZR.4.37.D04.1.454.CMB.2.raw
  modified_base (358)..(358): a, c, t, g, unknown or other
  modified_base (376)..(376): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctccgtgcgaaggcttctggactacaccttcacccgtcctactatatcgcacgtgggtcgcgactcggcccctaggacgaagggtcttaggaggtggagtgggatggactccgacctagnggcggtgacacgaaagtncgacagagtagttcgagggcgtagggtcaccgagtacgaccgagggacctacgtaccactacacgccaccgtaccagtcacgcaacgacgtaccacgacgtcggaccgtaggacgaccggcgtacggaccgtacgtacgaccgaacgtaccgacggtaacccgtagttacgttcgtgacggtcggaaggagg

SEQ ID NO: 402490 - DNA, 541 bp, Homo sapiens
  misc_feature: GZ8MTXP02FYZO7.4.37.D04.1.454.CMB.2.raw
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctgggcctcagtgaggtctcctgcaaggcttctggatacaccttcaccgcctactatatgcacgtggtgcgactcggcccctggaccgaagggcttaggaggttggaagtggggatgggatccgaccctaagacggcggtcggacacgaaagtatgacacgaggtaacgtttcgagggcgagggtcacgagtgaccgagggacacgtccaagtcaggccacggtccatccagccaacgacgacctacatcggacctggacgcggcctagacctagtctcgaccgacgacggtccgttatagtttccgngttcgacgtaggggtaag

SEQ ID NO: 402491 - DNA, 490 bp, Homo sapiens
  misc_feature: GZ8MTXP02IYSY5.4.37.D04.1.454.CMB.2.raw
  modified_base (357)..(357): a, c, t, g, unknown or other
  modified_base (420)..(420): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttctggatacaccttcaccgcctactatatgcactgggtgcgactggcccctggacaagggcttgagtggatgggatggatccgaccctacagcggtggcacagtatgcacngaagtttcagggcaggtcacagtgacaggacacgtcatcagcacgtcatcagcacacgcctanatcggacctgagcgcgtgacagtcgtagacgacgacggacgtaagtactttcgtgtgcggtaggagtagg

SEQ ID NO: 402492 - DNA, 616 bp, Homo sapiens
  misc_feature: GZ8MTXP02H78LI.4.37.D04.1.454.CMB.2.raw
  modified_base (245)..(245): a, c, t, g, unknown or other
  modified_base (257)..(257): a, c, t, g, unknown or other
  modified_base (360)..(360): a, c, t, g, unknown or other
  modified_base (379)..(379): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccgtggggcctcgagtgaaggtctccngcaaggcttcgnggactaccaccttccacccgtcctactatatgcacgtgggtgcgacgtcggccccgtggacgaagggcttggaggtggagtggggatggactccgacctacgnggcggtgacacgaaagttngaccaagagtaacgtttcgacgggtacgagggtcaaccgagtcgaaccgagggacctaccgtaccgactacgacgccgaccgtaccgaagtccaacgaccaaacgacggacccttaaacgacggtaccggtaccgtacgggaaccggtccgggaccgtcggaaccacgttaccgacgaaccgtaaccgacgggtaacccttagtaacgtttcgtacggtcggacgggtaaggggagg

SEQ ID NO: 402493 - DNA, 513 bp, Homo sapiens
  misc_feature: GZ8MTXP02FXAIV.4.37.D04.1.454.CMB.2.raw
  modified_base (226)..(226): a, c, t, g, unknown or other
  modified_base (252)..(252): a, c, t, g, unknown or other
  modified_base (347)..(347): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttcgnggatacaccttcaccgcctactatatgcacgtgggtgcgactcggcccctggaccgaagggcttggaggtggatgggatggactccgacctaagngcggtgacacgaaagtatgaccagaagtaagtttcgagggcagggtcaaccagtcgacagggacacgtcatcagcacgtccatcagcacacgcctacagtcggactgacgtcggcctagaccagtcacgaccgacgacgcgtatacttagcgtagacggagggtag

SEQ ID NO: 402494 - DNA, 585 bp, Homo sapiens
  misc_feature: GZ8MTXP02IOKQJ.4.37.D04.1.454.CMB.2.raw
  modified_base (197)..(197): a, c, t, g, unknown or other
  modified_base (372)..(372): a, c, t, g, unknown or other
  modified_base (584)..(584): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctgaggtgaagaagccgtggggcctcgagtgaaggtctccgtgcaaggcttcgtggactacaccttcaccgcctatatatgcacgtgggtgcgactcggcccctaggaccgaagggtctaggaggtggagtgggatggactccgacctaagggcggtggacacgaaaagtncggacaacgtaggtaacgtttcggagggtacgacgggtacaaccgagtacggaaccgaacgggaaccacgtaccagtaccgagacccaccgtacactacgacgaccacgaccgtaccacgacgtcggaccgtaggaccggcgggaccctaggacctagttaccgacgaaccgacgacgaacgttagtaacgtttcgaggtcgacgggaaggng

SEQ ID NO: 402495 - DNA, 576 bp, Homo sapiens
  misc_feature: GZ8MTXP02IH77V.4.37.D04.1.454.CMB.2.raw
  modified_base (252)..(252): a, c, t, g, unknown or other
  modified_base (289)..(289): a, c, t, g, unknown or other
  modified_base (563)..(563): a, c, t, g, unknown or other
  modified_base (575)..(575): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctcagtgaggtctcctgcaaggcttcgnggatacaccttcacccgcctactatatgcacgtgggnccgacgtcggcccctggaccgaaggggtcttggaggtggagtgggagtggactccgacctaagaggcggtggacacgaaagtatgacaacgtagtaaacgtttcgagggcgtacggggtacacgagtacgaaccgacggggaaccaccggtacccagtaccgaacgccaaccgtcccaatacgacgaccaaccgacgaccctaacgacgtacggaaccgtggaacggtccgggctacggacaacgtcgacgaacgacgacgcgtatacgttcgngtcgacggaggng

SEQ ID NO: 402496 - DNA, 535 bp, Homo sapiens
  misc_feature: GZ8MTXP02H6Y5Z.4.37.D04.1.454.CMB.2.raw
  modified_base (229)..(229): a, c, t, g, unknown or other
  modified_base (248)..(248): a, c, t, g, unknown or other
  modified_base (382)..(382): a, c, t, g, unknown or other
  modified_base (440)..(440): a, c, t, g, unknown or other
  modified_base (475)..(475): a, c, t, g, unknown or other
  modified_base (521)..(521): a, c, t, g, unknown or other
  modified_base (534)..(534): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccaggtgcagctggtgcagtcgtggggctgaggtgaagagccgtggggcctnagtgaggtctctgcagctngatacactcaccgctactatatgcacgtgggtgcgtaccgtccgggccccctggacgaaggggtcttggaggtggagtggggattggacctaccgaaccccgtaaacgacgggtcggtacggacacgaaaagtntacggacaacgtaggtaagtttcgagggcgaggtcacgagtgaccgaggacacgtcanacagcacgtcatcagacacacgctacagtcgtacngacgcggactgactacgctcgacgacgacggtcgtactagttcggngtcggacggaggng

SEQ ID NO: 402497 - DNA, 543 bp, Homo sapiens
  misc_feature: GZ8MTXP02JUAGS.4.37.D04.1.454.CMB.2.raw
  modified_base (325)..(325): a, c, t, g, unknown or other
  modified_base (347)..(347): a, c, t, g, unknown or other
  modified_base (366)..(366): a, c, t, g, unknown or other
  modified_base (529)..(529): a, c, t, g, unknown or other
  modified_base (536)..(536): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcgagtgaggtctcctgcaaggtcttctggatacaccttcaccgctactatatgcacgtgggtcgccgacgtcggcccctaggacgagggtctggagtggangggatggataccccgacctagnggcggtcgacaactaagtnacgcaactaggtagttcgagggacgagggtccacctagacgacgacggacacgtactaagtacgaccacgtcccgataccgacgacacgacacctacagtcgaccgtggacgcggcacggtacgagtccgagacgacgacgtaccgataagttcggacgtagnggacggngaggtgg

SEQ ID NO: 402498 - DNA, 544 bp, Homo sapiens
  misc_feature: GZ8MTXP02F4XU2.4.37.D04.1.454.CMB.2.raw
  modified_base (227)..(227): a, c, t, g, unknown or other
  modified_base (247)..(247): a, c, t, g, unknown or other
  modified_base (362)..(362): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctnagtgaggtctctgcagcttngatacacttcacgtctactatatgcagtgggtgcgtacgtcggccccctggactaagggcttaggaggttggagtgggatggactccgaccctaagcggcggtagcagtaaagtntgacaacgagtaaggtttcgagggcgaggtcacagtcgaccgaggacacgtcatcgagcacgtccataccacgacaccgtacgacctacgtagtccggtacgacggacggaccggacgtacgacgacgtaccgcggtaaccaccgacggtccttaagtacgtttctggacggacgtaggagg

SEQ ID NO: 402499 - DNA, 621 bp, Homo sapiens
  misc_feature: GZ8MTXP02G9DRA.4.37.D04.1.454.CMB.2.raw
  modified_base (260)..(260): a, c, t, g, unknown or other
  modified_base (375)..(375): a, c, t, g, unknown or other
  modified_base (396)..(396): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacgaggacgccccactcccgaggtgcagctggtgcagtcgtggggctggaggtagaagaagcgtgggcctgagtgaacggtctcgtgcgaagtcttcgnggatacctaccttcacccgtcctaatatactgaccgtacgtgggtcgaccgacgtccggccccgtggaacgtaaggtctggaggtggagtgggatcggactaccgaaccctacgnggcggtacgacacgtaaagtntcgacaacgtaggtaaacgttccgagggaccgacgggtacaccgagtaacgaacgacgggtacaccgtacaactcgacgtaccaccgtcgaactcgaccggacaccgtacgaccgtacgtaacggtcgtaaccgtcgacggaccggccgtagaccgtacgtacgtacgaaaccgacgtaccggttaacgttaacttcgttcgtaggtacggacggtaaggaacgg

SEQ ID NO: 402500 - DNA, 550 bp, Homo sapiens
  misc_feature: GZ8MTXP02I1FVO.4.37.D04.1.454.CMB.2.raw
  modified_base (339)..(339): a, c, t, g, unknown or other
  modified_base (348)..(348): a, c, t, g, unknown or other
  modified_base (353)..(353): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcagtgggtgcgactcggcccctggacagggcttggagtggatgggatggactcgacctangcggtgcanaagtntgacacagtaagttcgaggggcacgggtcacgagtcgaaccgagggacacgtaccatcgacgcctacgtaccatccgagaccacgacgacctagacgtcggacctggacgcggtacgtagaacgtacgtcgtacgaaccggaccgaccgggtaaccgttacgtttaacgtttccgaggttcggacgggaagggtagg

SEQ ID NO: 402501 - DNA, 569 bp, Homo sapiens
  misc_feature: GZ8MTXP02FWVN9.4.37.D04.1.454.CMB.2.raw
  modified_base (395)..(395): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtagaagaacgccgtggggcctcgagtgaaggtctcctgacgaaggtcttcgaggactaccaccttcacccgtcctaactatacgtgacacgtgggtcgcgtacgtcggcccctaggacgaaggtcttaggaggtggagtgggatcggacctaccgaccctaagcggtcggtacggacacgaaagtncgacacgtagtaacgttcgagggcaggtcacgagtacgacgagggacacggtaccagtacagaccacgtacatcgagcacgcgactagacgtcgaaccgnggacgcgacgtacgacgtacgtacgacgacgacgtacgtaacgttagtacgttacgcggtacggacggaggtag

SEQ ID NO: 402502 - DNA, 625 bp, Homo sapiens
  misc_feature: GZ8MTXP02JMY46.4.37.D04.1.454.CMB.2.raw
  modified_base (544)..(544): a, c, t, g, unknown or other
  modified_base (607)..(607): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacgaggacgcccacctcccgaggtgcagctggtgcagtcgtggggctggaggtagaagaacgccgtggggcctacgaggtggaacggtcctccgtgacgaaggtcttcgaggaactaccgtacccttcgaccccgtacctaactatagcgtacctacggtgggtcgacgtaccgtccggccccgtaggaacgaggtctaggagtggagtggagtggaccgtaccgacctaagaggtcggtagaccagtaagttagcgtaccagtaagtaagttcggaagggtcgacggtccacgagtacgaccgacgggactaccgtcacgtaccgaggcctaccgtacacgacgacgaccgaacaccgtacctacgtacgccggtaaccggnggaccggtccgtacgagaccgtacgtacggaccgaccgacgacgtaacgttagttacgtacgnggtacggtaggacggtag

SEQ ID NO: 402503 - DNA, 579 bp, Homo sapiens
  misc_feature: GZ8MTXP02F01PH.4.37.D04.1.454.CMB.2.raw
  modified_base (250)..(250): a, c, t, g, unknown or other
  modified_base (565)..(565): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgccccactcccaggtgcagctggtgcagtcgtggggctgaggtgaagagcgtggggcctcagtgaggtctcctgcaggcttnggatacaccttcaccgcctactatatgcacgtggtgcgacgtcggcccctggacgaagggtcttggaggtggagtgggatggactaccgacctaacgaggcggtggacacgaaagtgtagacgaggaagttaagtttcgaggggacgtagggttcaacgtagtacgaaaccggaggggaacctaccggtaccacgtcaacgcctaaccgtacctagtaccaacggaccaaaccgacgtacctacgaacgtcggaactggaaccgcgggacctacggactacgtcgtacgaacgcgacgtaacgtacttacttcgngtaggacgaggtag

SEQ ID NO: 402504 - DNA, 518 bp, Homo sapiens
  misc_feature: GZ8MTXP02FODAY.4.37.D04.1.454.CMB.2.raw
  modified_base (290)..(290): a, c, t, g, unknown or other
  modified_base (350)..(350): a, c, t, g, unknown or other
  modified_base (366)..(366): a, c, t, g, unknown or other
  modified_base (437)..(437): a, c, t, g, unknown or other
  modified_base (441)..(441): a, c, t, g, unknown or other
  modified_base (448)..(448): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcaccgcctactatatgcacgtgggngcgacgtcggcccctggacgaagggtcttggagtggagtgggatggactcgaccctaagngcggtgacagaaagtntgacacaaggtagtttcgaggggcagggtcaacagtacgaaccgagggacacgtcatcagcacgtcatcancacngacctanagtcgactggacgcgcctgacacgtcgacgacgacgacggtcgtatacgttcgtagtcggacggaggtag

SEQ ID NO: 402505 - DNA, 590 bp, Homo sapiens
  misc_feature: GZ8MTXP02GPKUN.4.37.D04.1.454.CMB.2.raw
  modified_base (227)..(227): a, c, t, g, unknown or other
  modified_base (248)..(248): a, c, t, g, unknown or other
  modified_base (365)..(365): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctnagtgaggtctcgtgcagctcngatacacctcaccgctactatatgctacgtgggtcgcgacgtcggccccgtggacgagggtctaggaggtggagtggggatggacctccgaccgtagacggcggtgacacgaaagtntcgacaagtaggtacgtttacggagggcgtacggtcacgatacgaccgagggacaccgtacactacgacgtccacgtccactacgacgaccaacgtacgacctacgtacggtaccggaaccgtcggacggaccgggtacctacggtacctaacgtaccgtacggaacccgaccgtacggtccgttaatttaccgttcgtacggtacggacgggtagggtaacggg

SEQ ID NO: 402506 - DNA, 533 bp, Homo sapiens
  misc_feature: GZ8MTXP02I6CIH.4.37.D04.1.454.CMB.2.raw
  modified_base (227)..(227): a, c, t, g, unknown or other
  modified_base (362)..(362): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaggtctctgcaaggcttctgatacaccttcaccgcctactatatgcagtgggtgcgactcggcccctggacaagggcttgagtggagtgggatggactccgaccctaagacggcggtaggacacgaaagtntgaccaagaagtaagtttcgagggcgtacgggtcaaccgagtcgaacgacgggacacgtaccagtcgagacaccgtcatcacgaccacgacgcctacgagtcggacctgacggcggcgtagacgagtcgacgacgacgtacgaacgtagtacttgtcgtgacggtaggagg

SEQ ID NO: 402507 - DNA, 568 bp, Homo sapiens
  misc_feature: GZ8MTXP02GDC8Q.4.37.D04.1.454.CMB.2.raw
  modified_base (497)..(497): a, c, t, g, unknown or other
  modified_base (517)..(517): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctggaggtgaagaagccgtggggcctgagtgaaggtctccgtgcaaggcttcgtggactacaccttcaccgcctactatatgcacgtgggtgcgactcggcccctggacgaagggtctggaggtggagtggggatggactaccgaccctaacgaggtcgggtaggacagaaacgtgtacgacctacgaaggtaacggtttcggacgggcgaacggggtccaacgatacgaccgacgggacacggtacagtcacgcgaccgtcatccgacgcaacgtcgacctacagtcggtaccnggacgaccggtctaggaccngtactcggaacgccgacggtccgttatacgtttcaggtgacggaggtacgg

SEQ ID NO: 402508 - DNA, 477 bp, Homo sapiens
  misc_feature: GZ8MTXP02FS7ZX.4.37.D04.1.454.CMB.2.raw
  modified_base (223)..(223): a, c, t, g, unknown or other
  modified_base (334)..(334): a, c, t, g, unknown or other
  modified_base (446)..(446): a, c, t, g, unknown or other
  modified_base (453)..(453): a, c, t, g, unknown or other
  modified_base (460)..(460): a, c, t, g, unknown or other
  modified_base (466)..(466): a, c, t, g, unknown or other
  modified_base (468)..(468): a, c, t, g, unknown or other
  modified_base (476)..(476): a, c, t, g, unknown or other
tcagagcactgtagcacgaccggtgctcgattagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctgtgcagtctggggctgaggtgaagaagcctggggcctnagtgaaggtctcctgcaaggcttctggatacaccttcaccgcctactatatgcactgggtgcgactggcccctggacaagggctgagtggatgggatggatcgaccctaanagcggtgcacaaagtatgcacagaaagtttcggggcagggtcaccatgaccaggacacgtccatcagcacgtccatcagcacagcctacatggacctgagcggcctgcatcncacgacngccgaanatttcngngcgagagng

SEQ ID NO: 402509 - DNA, 575 bp, Homo sapiens
  misc_feature: GZ8MTXP02FMKY5.4.37.D04.1.454.CMB.2.raw
  modified_base (223)..(223): a, c, t, g, unknown or other
  modified_base (234)..(234): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggcctnagtgagtctcngcaggctctggatacaccttcaccgcctactatatgcacgtgggtgcgactcggcccctggacgaagggcttggagtggagtggagtggactcgaccctaacgaggcgggtggacagaaagtatgacaacgaaggtaacgtttcgaggggcgagggtcaacgagtcgaccgaggacgaccgtcacgtcgacgccgtaccgtaccacgtcgaacggaccaaccgacgtaccctaacgtacgtacggaacccgtgggaaccgccggggacctacggaccgaacgtcggtacgaacgaaccggacgaaccgttagttacgtttcgagtcggacggtagggaagg

SEQ ID NO: 402510 - DNA, 524 bp, Homo sapiens
  misc_feature: GZ8MTXP02GMK02.4.37.D04.1.454.CMB.2.raw
  modified_base (249)..(249): a, c, t, g, unknown or other
  modified_base (338)..(338): a, c, t, g, unknown or other
  modified_base (505)..(505): a, c, t, g, unknown or other
  modified_base (514)..(514): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacagaagcccactcccaggtgcagctggtgcagtctggggctgaggtgaaaagccgtggggctcagtgaaggtctctgcaaggcttcnggatacaccttcaccgcctactatatgcacgtgggtgcgactcggccctggacaagggcttggagtggatgggatggactccgacctangcggtggacacagtatgacacgagagtttcgagggtcgagggtccacgatacgaccgaggaccacgtccatacagcacgtaccatcgacgacacgacgacctacacgtacggacctggacggccgcgtagactactcgacgacgacgacgccgtaagttacgttcgnggtgacggnggacgtaggg

SEQ ID NO: 402511 - DNA, 578 bp, Homo sapiens
  misc_feature: GZ8MTXP02HMBX9.4.37.D04.1.454.CMB.2.raw
  modified_base (377)..(377): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactccccaggtgcagctggtgcagtcgtggggctgaggtgaagaagccgtggggcctcgagtgaacggtctccgtgcaaggcttctggactaccaccttcaccgtcctactatactgccacgtgggtcgccgacgtcggacccctggacgaagggcttggagtggagtgggatggatcccgaccctaagcggcggtgacaacgtagtntagcaacgagtaagttcgaggcgaggtcacgagcgacgagggtacacgtaccactacgacgacgacgtccacgtacgacgccaaccgacgaccccgtaagacgtcgggacctagggaacgccgggtcctacggactacgtaccgtacggaaccgacgtaccgacgttaactgttaccgtggtagccgggaggttagagggg

SEQ ID NO: 402512 - DNA, 590 bp, Homo sapiens
  misc_feature: GZ8MTXP02IV3CE.4.37.D04.1.454.CMB.2.raw
  modified_base (362)..(362): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccgcctactatatgcacgtgggtgcgacgtcggcccctaggacgaagggcttggagtggagtgggatggactcgacctagagcggtgcacgaaagtntgacaacgtagtagtttcgaggggcagggtaccaaccgagtacgaaccgacggggacctaacggtccagtaccaggacctaccggtccagtccacggaccaaccgacggacccttacgaacgttcggaacccgtggaaccggtccgggacctacgggaccttaacggcgtacgaaacggtaccgtaacggcccgttattaccgtttcggtaggtacggacggaggtag

SEQ ID NO: 402513 - DNA, 512 bp, Homo sapiens
  misc_feature: GZ8MTXP02I7X0G.4.37.D04.1.454.CMB.2.raw
  modified_base (337)..(337): a, c, t, g, unknown or other
  modified_base (345)..(345): a, c, t, g, unknown or other
  modified_base (352)..(352): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctaactatatgcactggtgcgactggcccctggacaagggctgagtggatgggatggatcgaccctaangcgtgcanaaagtangacacagtaagttacgaggacgaggtacgacatacgaccgacggacgacgacacacacgacactacactacacgacacacgactactatagacgagacgcggcgtacgacgaacgacgtacgaacgaacgacgaacgtacgtacgtctgtacgcgaggag

SEQ ID NO: 402514 - DNA, 500 bp, Homo sapiens
  misc_feature: GZ8MTXP02IU0XP.4.37.D04.1.454.CMB.2.raw
  modified_base (287)..(287): a, c, t, g, unknown or other
  modified_base (354)..(354): a, c, t, g, unknown or other
  modified_base (358)..(358): a, c, t, g, unknown or other
  modified_base (437)..(437): a, c, t, g, unknown or other
  modified_base (462)..(462): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagaagcctggggcctcagtgaaggtctcctgcaaggcttctggatacaccttcaccgcctactatatgcacgtgggtncgactggcccctggacaagggcttgagtgagtgggatggatccgaccctacagcggtgcaacagtangcanagtaagtttcgagggacgaggtcaccagtacgaaccgagggaccacgtcatcagtcacgtccatcagcacacgcctacngtacgactgacgcgctgacacgtcngacgacacggtctaatcgttcgagtcgacgaggatagg

SEQ ID NO: 402515 - DNA, 507 bp, Homo sapiens
  misc_feature: GZ8MTXP02F2G2V.4.37.D04.1.454.CMB.2.raw
  modified_base (337)..(337): a, c, t, g, unknown or other
  modified_base (352)..(352): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatccgaccctaanagcggtgcaacagtntgcacagaagtttcgagggcagggtcacgatgacagggacacgtcatagcacgtcatcagcacacgacctacagtcggaacctggaacggccggcctacggacagtcgacgacgacgacggccgtataacgtttctgtgacgagggagagtaggg

SEQ ID NO: 402516 - DNA, 565 bp, Homo sapiens
  misc_feature: GZ8MTXP02G4Y15.4.37.D04.1.454.CMB.2.raw
  modified_base (369)..(369): a, c, t, g, unknown or other
  modified_base (385)..(385): a, c, t, g, unknown or other
  modified_base (458)..(458): a, c, t, g, unknown or other
  modified_base (472)..(472): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccgaggtgcagctggtgcagtcgtgggctggaggtgaagagccgtgggcctgagtgaaggtctcgtgcaaggtcttcgtggatacgaccttcacccgtcctactatagtcgacacgtggggtcgcggtactcgggcccccgtaggaacgaagggtcttggaggtggaagtggggattggacctccgacctaagngcggtgacacgaaatncgacacgaagtagttcgaggcgtacgggtcaacgtagacgaccgagggaccacgtaccatacagcgacgtcanacacgacacgtacncctaacacgtacggaccgagacgcggtaccaggactaacgtcgacgaaccgacgtacggtccgtaattcgttcgtgggacggacggaggtagg

SEQ ID NO: 402517 - DNA, 550 bp, Homo sapiens
  misc_feature: GZ8MTXP02HW7XL.4.37.D04.1.454.CMB.2.raw
  modified_base (376)..(376): a, c, t, g, unknown or other
  modified_base (465)..(465): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccaggtgcagctggtgcagtcgtggggctggaggtgaagagccgtggggcctcgagtgaggtctcctgcaaggcttcgtggactacacccttcacccgcctatatatgctagtgggtcgcgactcggcccctggacgaggtcttggagtggagtggggatggactccgtaaccctagaggtcggtggacacgtaaaagtntagaccgaagtaaggtagtttcggagggacgagggtacactagacgacgacggacacgtaccactcgacgcaccgtcactcacgacacncgacctacacgtacgacgtgacggtcggaccgtagacacgtcgacgacgacgacggtaaccgtattattcgagcgacggaggagg

SEQ ID NO: 402518 - DNA, 504 bp, Homo sapiens
  misc_feature: GZ8MTXP02JTSYY.4.37.D04.1.454.CMB.2.raw
  modified_base (253)..(253): a, c, t, g, unknown or other
  modified_base (341)..(341): a, c, t, g, unknown or other
  modified_base (356)..(356): a, c, t, g, unknown or other
  modified_base (452)..(452): a, c, t, g, unknown or other
  modified_base (503)..(503): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttcnggatacaccttcaccgcctactatatgcacgtgggtgcgactcggcccctggacaagggcttgagtggatgggatggactcgacctangcggtgcacaaagtntgcacagtagttcgagggcgaggtcacagtcgacgagggacacgtcatccagcacgtcatacgagcacacgccctagagtcggacctgacgccgcnggaccagtccagacgaccgacggccgtattacgttcgtggcgacggtaggng

SEQ ID NO: 402519 - DNA, 530 bp, Homo sapiens
  misc_feature: GZ8MTXP02FHHX3.4.37.D04.1.454.CMB.2.raw
  modified_base (339)..(339): a, c, t, g, unknown or other
  modified_base (355)..(355): a, c, t, g, unknown or other
  modified_base (429)..(429): a, c, t, g, unknown or other
  modified_base (525)..(525): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctgggggctggaggtgaagaagcctggggcctcagtgaaggtctcctgcaaggcttctggatacaccttcaccgcctactatatgcactgggtgcgactggcccctggacaagggctgagtggatgggatggatcccgaccctaanagcggtggcacaagtntgcacagaagtttcagggcaggggtcaccgatcgaccgagggaccacgtccatcagcacgtccatcagccaacncgaccctacagtacggaccctgacgccggacctggacactccgtacgaccgtacaccgggtacctaagttactttcgtaggttcgacggagggganaaggg

SEQ ID NO: 402520 - DNA, 556 bp, Homo sapiens
  misc_feature: GZ8MTXP02H21DK.4.37.D04.1.454.CMB.2.raw
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctgagtgaaggtctcctgcaaggcttcgtggatactaccttcacccgcctactatatgcacgtgggtgccgactcggccccgtggacgaagggcttggagtggagtgggatggactccgaaccctaacgaggcggtggacacgaaagtatcgacacgaagtaacgtttcgagggtcgacgggtacaccgatacggaccgacggggaacaccggtaccagtcacgtaccaccgtaccagtaccgacgaccaccacgacctacgaagtcggacctggacgtccggctagacatcgacgacgacacggctagtacttcgtagcgtacggaggagg

SEQ ID NO: 402521 - DNA, 512 bp, Homo sapiens
  misc_feature: GZ8MTXP02G0CFY.4.37.D04.1.454.CMB.2.raw
  modified_base (226)..(226): a, c, t, g, unknown or other
  modified_base (342)..(342): a, c, t, g, unknown or other
  modified_base (357)..(357): a, c, t, g, unknown or other
  modified_base (362)..(362): a, c, t, g, unknown or other
  modified_base (402)..(402): a, c, t, g, unknown or other
  modified_base (413)..(413): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctggaggtgaagagcgtgggcctnagtgaaggtctcctgcaaggcttctggataccaccttcaccgcctactatatgcacgtgggtgcgactcggcccctggacaagggcttggagtggatgggatgactcgaccctagngcgtgcacgaaagtngacanagaagttcgaggcaggtcacgatcgacagggacacgtcancagcacgtcancacgcactacgacctacagtcgacctggaacgccggccgtaggaccagtacgacgacgaccgacggaaccgtatacgtttcggagtacgacggaggacg

SEQ ID NO: 402522 - DNA, 564 bp, Homo sapiens
  misc_feature: GZ8MTXP02GYE3T.4.37.D04.1.454.CMB.2.raw
  modified_base (362)..(362): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtcgtggggctggaggtagaagaagccgtggggcctcgagtgaaggtctccgtgcaaggcttcgtggataccaccttcacccgtcctactatatcgcacgtgggtgcgacgtcggccccgtaggaccgaagggcttggagtggagtggagtggactccgaccctaagnggcggtagacacgaaagtgtacgacacgagtacgttacgagggcgtaggtccaacgatacgaccgaggacacgtacactcgagcctaacgtccatccgagaccacgacgtaccgtacacgttcggaccgtgaccggtcgaccgtagactacgcgtacgacgtacgacggtcgtattacggttccaggtcgacggaggtacgg

SEQ ID NO: 402523 - DNA, 481 bp, Homo sapiens
  misc_feature: GZ8MTXP02FE3FV.4.37.D04.1.454.CMB.2.raw
  modified_base (226)..(226): a, c, t, g, unknown or other
  modified_base (287)..(287): a, c, t, g, unknown or other
  modified_base (327)..(327): a, c, t, g, unknown or other
  modified_base (339)..(339): a, c, t, g, unknown or other
  modified_base (423)..(423): a, c, t, g, unknown or other
  modified_base (471)..(481): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctgggggctggaggtgaagaagcctggggcctnagtgaaggtctcctgcaaggcttctggatacaccttcaccgcctactatatgcactgggtncgactcggcccctggacagggctgagtggatgggatggancccgacctaacngcggtgcaacaagtatgcacagtaagtttcgagggcagggtcacgatcgaccgaggaccacgtcatcagcacgtcatcagacanacgacctacagtcgacctgagccgggactggacgaacggcgacagagnnnnnnnnnnn

SEQ ID NO: 402524 - DNA, 560 bp, Homo sapiens
  misc_feature: GZ8MTXP02I2PRY.4.37.D04.1.454.CMB.2.raw
  modified_base (229)..(229): a, c, t, g, unknown or other
  modified_base (251)..(251): a, c, t, g, unknown or other
  modified_base (373)..(373): a, c, t, g, unknown or other
  modified_base (547)..(547): a, c, t, g, unknown or other
  modified_base (549)..(550): a, c, t, g, unknown or other
  modified_base (552)..(553): a, c, t, g, unknown or other
  modified_base (555)..(556): a, c, t, g, unknown or other
  modified_base (558)..(560): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaggtctctgcaaggcttnggatacaccttcaccgcctatatatgcacgtgggtcgcgacgtcggcccctaggacaaggggtctggaggtggagtggggatggactccgaaccgtaacgaggtcggtacgacacgaaagtntacgacaagaaggtaagtttaccgagggtcgacgggtacaccgagtacgaccgaggggaaccacggtaccatacgacggcctaaccgtccaagtaccacgaccaacctacgacctaacgacgtcggaacccgtggacggccgggtcgacgggacgaaacggggcaccgaaaggngnngnncnncnnn

SEQ ID NO: 402525 - DNA, 582 bp, Homo sapiens
  misc_feature: GZ8MTXP02F8OED.4.37.D04.1.454.CMB.2.raw
  modified_base (255)..(255): a, c, t, g, unknown or other
  modified_base (296)..(296): a, c, t, g, unknown or other
  modified_base (475)..(475): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccatgtgcagctggtgcagtcgtggggctggaggtgaagaagccgtggggcctgagtgaaggtctcctgcaaggcttcgnggactacaccttccacccgcctaactatatgcacgtgggtncgactcggcccctggacaaggggcttggagtggagtgggatggatccgaacctaagcggcggtggacaaacgaaagtatcgaccgaaacgaaggtaagtttacgacggggtacgacggggtacaccgtagacggaaccgaagggaaccacgtaccactacgaacgaccaccggtccaanacgaacgaccacgtacgaccgtaacacgtacggacgtcggacgccggctacgacacgtcgacgacgaccgaacgtaccgtattacttcgtagtacggacggtaaggg

SEQ ID NO: 402526 - DNA, 606 bp, Homo sapiens
  misc_feature: GZ8MTXP02GMN1I.4.37.D04.1.454.CMB.2.raw
  modified_base (198)..(198): a, c, t, g, unknown or other
  modified_base (253)..(253): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgnggggctggaggtgaagaagccgtggggcctcgagtgaaggtctccgtgcagcttnggatacaccttcaccgcctactatatgacagtggtgcgacgtcggcccgtggacgaagggtctggaggtggtagtggggatggactccgaacccgtaacgaggcggtagacgacgaaagtatagacaacgtaaggtaacgtttcgaggggtcgacgggtacaccgagtacgacgacgggacaccgtaccactaccgaacgaccaccggtcctacgtacgaacggacaacccgaaccgtaccctaacgaacgtaccgggaccgtacgggaaccggtccggacccggtacgaccgtacgtaccgtacgaccgacgtaccgaacgttagttcgttacgtcgtaggacggaggtagg

SEQ ID NO: 402527 - DNA, 575 bp, Homo sapiens
  misc_feature: GZ8MTXP02IYA0Q.4.37.D04.1.454.CMB.2.raw
  modified_base (254)..(254): a, c, t, g, unknown or other
  modified_base (358)..(358): a, c, t, g, unknown or other
  modified_base (376)..(376): a, c, t, g, unknown or other
  modified_base (512)..(512): a, c, t, g, unknown or other
  modified_base (540)..(540): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaggtctcctgcaaggcttcgngactacaccttcaccgcctactatactgctagtgggtcgccgtacgtccggcccccgtaggacgaaggtcgttgaggtggagtgggatggactccgacctaagngcggtaggcacgaaagtntaggacctagaaggtaagtttcgaaggggtacaggggtaccaacgtagacgaaaccgacggggaacaccgtaccaacgtcgaaacggccctaaccgtccaagtccgaaggaccacgacgtaccaactagtcgacgngacgcggactgacgtatcgtcgaaccgngaccggtctaactacttcggtagcggtagaggtag

SEQ ID NO: 402528 - DNA, 640 bp, Homo sapiens
  misc_feature: GZ8MTXP02GEM5A.4.37.D04.1.454.CMB.2.raw
  modified_base (249)..(249): a, c, t, g, unknown or other
  modified_base (287)..(287): a, c, t, g, unknown or other
  modified_base (344)..(344): a, c, t, g, unknown or other
  modified_base (360)..(360): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctgagtgaaggtctcctgcaaggcttcnggatacaccttcaccgcctaactatatgcacgtgggtncgacgtcggccctaggacaagggcttagagtggagtgggatggactccgaacctagngcggtgacaacgagtntgacacgagtaacgtttcgagggtacagggtacaccgagtacgaaccgaaggggaccaacgtacccgtaagttacgacctaaccggttaccaagtaccacgaccaaacgaccgtaaccctaacgaagttaccggaacccgtaggaacggccgggtacccgtaaggaccgtaaacggttccgaacgggaaacccgaccggtaaaccgggtccgttaaattaacgttttccgtacgggtacggtaaccgggtaacggggtaacggaacgggtttaacggggg

SEQ ID NO: 402529 - DNA, 717 bp, Homo sapiens
  misc_feature: GZ8MTXP02HDQCV.4.37.D04.1.454.CMB.2.raw
  modified_base (254)..(254): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaaggcttcgnggatacaccttcaccgcctactatatgacacgtgggtgcgacgtcggccccgtaggacgaagggtcttggagtggagtgggatggactaccgaacctaagaggcggtggacacgaaagtatggacaaacgaggtaacggtttcaacgggggacgtaggggttaccaacccgtaaagtacggaacccgaagggggaaccctaaccgggttacccaaagtccgaaacggaccgtaaccccggttaccctaacgtaccccgaaagggacccgaaaccttaaaccgggtaccccctttaaacggaacgttaccgggggaaaccccgtttagggaacccggggaccccggggtacccgttaccgggaaccgaaaccgggttccgaacggttaaccggaaacccgtaacggggtcccgttaataacggtttttccggtacggtaacggggtacgggtaacggggtaagg

SEQ ID NO: 402530 - DNA, 675 bp, Homo sapiens
  misc_feature: GZ8MTXP02JMHWZ.4.37.D04.1.454.CMB.2.raw
  modified_base (197)..(197): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctgaggtgaagagccgtggggcctcagtgaggtctccgtgcaaggcttcgtggatacaccttcaccgtcctactatatgcacgtgggtgccgacgtcggccccctggacaaggggctttggagtggatggggattgggactccggaaccctaagacggtcggggtacggacaacgtaaaggttctacggaccaacgtaaggtaaacggttttcgaacgggggacgtaacgggggtacccaaccggtagtaccggaaccggaacggggacctaaccgggttaccaaacttccgaaacggcccgtaaaccggttcccaaacgtacccgaacggacccaaaccgtacggaccctacgtaacgttaccggggaacccgtagggaacggaccgggtccgttacgggaaccgaacggttccgtacggaaccgtaacgacggtaaccggtaattacgttcgttgtacggacggtacggagg

SEQ ID NO: 402531 - DNA, 504 bp, Homo sapiens
  misc_feature: GZ8MTXP02I3RUH.4.37.D04.1.454.CMB.2.raw
  modified_base (254)..(254): a, c, t, g, unknown or other
  modified_base (376)..(376): a, c, t, g, unknown or other
  modified_base (443)..(443): a, c, t, g, unknown or other
  modified_base (494)..(495): a, c, t, g, unknown or other
  modified_base (497)..(504): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagaagccgtggggcctcgagtgaaggtctctgcaaggcttcnggataccaccttcaccgcctactatatgcacgtgggtcgcgacgtcggcccctggacaagggtcttgagtggagtgggatggactccgaaccctaagaggcggtgacacgaaagtatgacanaaggtaagttcgagggcgaggtcacgatacgacgagggacacgtacatcagacacgcatcagcaacngacctacgagtcgactggacgtcgggcgtagggacgaaaggcgactagagnngnnnnnnnn

SEQ ID NO: 402532 - DNA, 524 bp, Homo sapiens
  misc_feature: GZ8MTXP02IWAZ7.4.37.D04.1.454.CMB.2.raw
  modified_base (344)..(344): a, c, t, g, unknown or other
  modified_base (363)..(363): a, c, t, g, unknown or other
  modified_base (514)..(514): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcagtgaggtctcctgcaaggcttctggatacaccttcaccgcctatatatgcacgtgggtgcgacgtcggcccctggacaagggtcttggagtggatggggatggactccgacctaagnggcggtggacacgaaagtntggacacgaggtaaagtttcgagggtacgagggtcaccgagtcgacgagggacacgtcatcagcacgctagcagactacacgacctacagtacggacctggacgcggccgtaggacgtaacgtccgacgacgaacgcgtccgtatactcgngcgacgagng

SEQ ID NO: 402533 - DNA, 694 bp, Homo sapiens
  misc_feature: GZ8MTXP02IURCZ.4.37.D04.1.454.CMB.2.raw
  modified_base (243)..(243): a, c, t, g, unknown or other
  modified_base (252)..(252): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagcccacaggacgcccactccccaggtgcagctggtgcagtcgtggggctgaggtgaagaagccgtggggcctcgagtgaggtctccngcagtcttntggatacctaccttcaccgcctactatatgccacgtgggtcgccgtacgtccggccccgttaggaacgtaagggtcgttaggaggtagggtagtggggatgggaactacccccgaaaccccgtacgacgggtacgggtacggaccgtaaaccgtaaggtgtacgacgaaacgtaacggttaaacggtttacgaacgggaaccgtagggtacccaacgaacgtaccggaacccgaacgggtaccccaacgttaccgaagtacccgaacggaccctaaccggttacccaagtacccgacggtacccaacgaccgacccttaacgacgtccggaaccgtcggacgtaccggccgtagaaccgtcgtacgacggtaacccgacgtacccggtaacgttaacgttaacgtttcggtacgtacggtacggaggggtaacgttaagggg

SEQ ID NO: 402534 - DNA, 616 bp, Homo sapiens
  misc_feature: GZ8MTXP02F3RNW.4.37.D04.1.454.CMB.2.raw
  modified_base (258)..(258): a, c, t, g, unknown or other
  modified_base (388)..(388): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccagggtgcagctggtgcagtcgtggggctggaggtgaagaagccgtggggcctcgagtgaaggtctcctgcaaggcttcgnggatacaccttcacccgctactatatgcagtgggtgccgactcggtccccctgggaccaaggggtcttaggacggtggaagtggggattcggggactccgaaccctaagaggcggtggacacgaaaggtncgacacgagtaagtttcgaggggcagggtcaaccgagtacgaaccgtacgggaacacggtaccataccacgaccacgtcccagtccaacgaccgaacacgtactaacgtaagcggaacccgtgaacggccggaccgtaggacctacttacggtaccgaacggaccgtaaccggtaacggttaacttaacgttttacggtccggttaggaccggggaggggtaacgggg

SEQ ID NO: 402535 - DNA, 553 bp, Homo sapiens
  misc_feature: GZ8MTXP02I1ZMY.4.37.D04.1.454.CMB.2.raw
  modified_base (223)..(223): a, c, t, g, unknown or other
  modified_base (374)..(374): a, c, t, g, unknown or other
tcagagcactgtagcacgaccggtgctcgatttagtagcatactgttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcgtgggcctnagtgaaggtctcctgcgaaggcttcgtggactacgacccttcacccgtcctaactatactcgacctacgtgggtcgcgacctcggccccctaggacgaaggggtcttggagtggagtggatggactcgacctagagcggtgacagaaagtncgacacgagtagttcgagcgaggtcacagtcgacgaggacacgtacatacagcctacgtaccactacgacgacacgacgtacctaacgacgtacggacctcgacggccggtcacgacacgtacgaccgaacgtaccgacgggaaccttagtactttcgacggtacgacggaaggtacgg

SEQ ID NO: 402536 - DNA, 615 bp, Homo sapiens
  misc_feature: GZ8MTXP02H1RBW.4.37.D04.1.454.CMB.2.raw
  modified_base (319)..(319): a, c, t, g, unknown or other
  modified_base (595)..(595): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccaggtgcagctggtgcagtcgtggggctggaggtagaagagccgtgggcctgagtgaggtctctgcaggcttcgtggactacaccttcaccgtcctactatatgctacgtgggtcgccgactcggcccctaggacgagggtnttggagtggagtgggatggactaccgaccctagacggtcggtaggacacgtaaagttcacgacaacgtaggaaacggtttcggaacggggtacgaacgggggtaccaaccgacgtaccggaaaccgaacggggacctaaccggtaccagtaccacggtacctacgtacccgactaccgacgaccacgaccgacctacgacgtacggaccgtacggacggcgccgtacgactacgtaccgacgaccgtaccgaccgtaaccgtagttaccgtttcgnggtaccgggcggtaaggagg

SEQ ID NO: 402537 - DNA, 555 bp, Homo sapiens
  misc_feature: GZ8MTXP02FMRZ7.4.37.D04.1.454.CMB.2.raw
  modified_base (249)..(249): a, c, t, g, unknown or other
  modified_base (554)..(554): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctgagtgaggtctcctgcaggcttnggatacaccttcaccgcctactatatgcacgtgggtgcgacgtcggcccctggacgaagggcttggagtggagtgggatggactccgacctagacggcggtggcacgaaagtgtgacacgaagtacgtttcgagggcgagggtcaaccgagtacgaaccgaacggggaccacgtaccagtacgacgaccaccggtaccagtcgaacggaccaacgtacgacctaacgacgtacggaccgtggacggtccggccgtacgggaccacggtccgacgtaacgacgacgcgtatactgtcgaggcgagng

SEQ ID NO: 402538 - DNA, 668 bp, Homo sapiens
  misc_feature: GZ8MTXP02FN0G3.4.37.D04.1.454.CMB.2.raw
  modified_base (256)..(256): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggtcttcgnggatacaccttcaccgcctatatatgcacgtgggtgcgacgtcggcccccgtaggacgaagggcttaggaggtggagtggggtatggtacttcgaacccctaaagacggtcgggtaggacacgaaagttagagacctaacgaaggtaaacgtttcgaagggggtaccgtagggtacccaaccgtagtacggacccgagggggaacctaccggtaccaagtccgaaggcccgaaccggttccaacgtaccgacggaccaaccgtacgaccctaacgtacgtaccgggaacccgttgggaaccgggcccgggaccgttaggaacccgtaaacggtcggttaccgtaaaccgaccggtaaccggtaaccgtttaaagttaccggtttacgtggttcgggaccgtaacgggggtag

SEQ ID NO: 402539 - DNA, 619 bp, Homo sapiens
  misc_feature: GZ8MTXP02GLD62.4.37.D04.1.454.CMB.2.raw
  modified_base (325)..(325): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgccagctggtgcagtcgtggggctggaggtgaagaagccgtggggcctgagtgaaggtctctgcgaagcttcgaggactaccaccttcaccgcctaactatatcgcagtggtgcgtacgtcggcccctggacgaggtcttggnggtggagtgggatggacctacgacccgaagcggcggtgacataaacgtgtagacagtaggtacgttacggagggtagacggtacacgtagtacgaaccggacggactaccgtacaacgtaccgagacccgtaaccggtacctaagacccgaacggtaccaaccgaaccgtccgttaaacacggtacggtaccccgagggtaacccggccgggaccgtaacggaccgttacggtaccgaccgaaagaccggtacggtaacttaacggttcgtacgtacgtacggacggaggtagg

SEQ ID NO: 402540 - DNA, 524 bp, Homo sapiens
  misc_feature: GZ8MTXP02IXSI5.4.37.D04.1.454.CMB.2.raw
  modified_base (236)..(236): a, c, t, g, unknown or other
  modified_base (249)..(249): a, c, t, g, unknown or other
  modified_base (431)..(431): a, c, t, g, unknown or other
  modified_base (451)..(451): a, c, t, g, unknown or other
  modified_base (458)..(458): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaggtcncctgcaggcttcngatacaccttcaccgcctactatatgcacgtgggtgccgacgtcggccccctaggacgaagggtcttggagtggagtgggatggactccgaccctaagaggcggtggacacgaaagtatggccaacgaggtaaagtttcgaaggggcaggggtccaacgagtcgacgagggacacgtccaancacgcacgtcatcagccacncgcctanactggacctggacgcggcctggaccagtcacgacacgacgcgtatccttcgagtcggacgaggagg

SEQ ID NO: 402541 - DNA, 672 bp, Homo sapiens
  misc_feature: GZ8MTXP02FYPGX.4.37.D04.1.454.CMB.2.raw
tcagagcactgtagcacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaggccgtggggcctcgagtgaacggtctcctgcgaaggtcttcgtaggactaccgtaccttccgacccgtcctaacctatacgtcgaccacggttggggtcgaccggtacgtccgggcccccgtagggacgtaacgggtcttggaggtggacgtggggatggacctaccgaacccgtaagcggtcggtaggacacgtaaagtgtacgaccaacgtaggtaaacggttcggaaggggacgtacggtccaaaccgtagtacgaaccgacgggtactaccggtaccaatccgacgcgaaccgacctaagcgacgaccaacgacgtaccctaacgtacgtacggaacctgggacggtccggtacgtacggaccgtaaacggtccgtaacggaaccgacggtaaacccgggtccgttaagttaaccgtttcggtacggtacgggtacgggacgggtaacggg

SEQ ID NO: 402542 - DNA, 498 bp, Homo sapiens
  misc_feature: GZ8MTXP02JI9AS.4.37.D04.1.454.CMB.2.raw
  modified_base (240)..(240): a, c, t, g, unknown or other
  modified_base (249)..(249): a, c, t, g, unknown or other
  modified_base (339)..(339): a, c, t, g, unknown or other
  modified_base (352)..(352): a, c, t, g, unknown or other
  modified_base (403)..(403): a, c, t, g, unknown or other
  modified_base (483)..(483): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcngcagcttcnggatacaccttcaccgcctactatatgcactgggtgcgactcggcccctggacaagggcttgagtggagtgggatggatcccgacctaangcggtgcacagtntgcacagagtttcgagggcagggtcacagtgacgaggacacgtcatcagcncgtccatcacgcacacgacctacagtcggacctgacgcggctaggacagtcgtacgacgacgacgccgtaagtacttcgngtgcggaggagtagg

SEQ ID NO: 402543 - DNA, 745 bp, Homo sapiens
  misc_feature: GZ8MTXP02IHJ59.4.37.D04.1.454.CMB.2.raw
  modified_base (390)..(390): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccaggtgcagcgtggtgcagtcgtggggctggaggtgaagagccgtggggcctcgagtgaggtctcctgcaggcttctggatacctaccttcaccgtcctactatatcgcacggtgggtcgccgacgtccggcccctaggacgaagggtcttaggaggtggagtggggatggactaccgaaccctagacggcggtacggactaacgtaaagtntacgaccaacgtaaggtaaacgtttccggaaggggtacgaacgggggtacctaaccgaacggttaccggaacccggtaaacggggaccctaaccggttacccgaaacgtaccgaaaccggtacccgtaacccgttaccgtaacgttacccgaacggaacccgaaaccgtaaccgtaaccccgttaaacgaacggttaacccgggtaaccgttacggggaacccgggtacccggtacccggttaaaccggaaccgtaacgttaccggttaccggaaaacccggtaacccgtaacccggggtaacccgtttaagttacttttaccgggtaggtaccgggaacggtaacgggggaagg

SEQ ID NO: 402544 - DNA, 609 bp, Homo sapiens
  misc_feature: GZ8MTXP02G0Y32.4.37.D04.1.454.CMB.2.raw
  modified_base (366)..(366): a, c, t, g, unknown or other
  modified_base (505)..(505): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccacctcccaggtgcagctggtgcagtcgtggggctggaggtagaagaagccgtggggcctgagtgaaggtctccgtgacaaggcttgagactacaccttccacccgtctactatagtgacctagtgggtgccgacgtccggccccgtaggacgtacgggtcttggagtggagtggagtggacctccgacctaagnggtcggagacacgtaaagtagtcgacaagtaaggtagttcggagggcgaacggtcaacgtagacggacgaacggggcctaacggccagtacggactaccgtaccgtacctagaccgacgaccacgacgtacctaaccgngtaccggacgtacgggaccggccgtacccgagtacacgttacgacggtacgacccggtacgtccggtttaatacgttcggtaggtcgggagggtaaacggtggg

SEQ ID NO: 402545 - DNA, 616 bp, Homo sapiens
  misc_feature: GZ8MTXP02IO3YZ.4.37.D04.1.454.CMB.2.raw
  modified_base (253)..(253): a, c, t, g, unknown or other
  modified_base (378)..(378): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccacctcccgaggtgcagctggtgcagtcgtggggctggaggtagaagaagccgtggggcctcgagtgaggtctctgcaggctngatacaccttcaccgctactatatgcacgtgggcgcgaccgtcggccccgtaggacgaagggtcttggaggtggagtgggatggacctaccgaaccctaagcggtcggtcgacacgtaaagtagngacgaacgtaggtaacggtttcggagggacgacgggtaccaacgagtacgaaccggacgggaaccgaccgtaccgacgtaccgacggaccgtaccggtacctagtacccgacgaacccgaacgtaaccgacccgtaacgaacgtaccggacccgtaggaccggtaccggacgtaggaccgtacgtccgacgaaccgtacggacgtaaccgtatacgttcgagtacggacggaggtagg

SEQ ID NO: 402546 - DNA, 574 bp, Homo sapiens
  misc_feature: GZ8MTXP02GHNQA.4.37.D04.1.454.CMB.2.raw
  modified_base (254)..(254): a, c, t, g, unknown or other
  modified_base (262)..(262): a, c, t, g, unknown or other
  modified_base (434)..(434): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacgaggacgcccactcccaggtgcagctggtgcagtcgtggggctggaggtgaagagccgtgggcctgagtgaggtctcctgacaggcttcgnggataccnccttcaccgcctactatatcgctacgtgggtcgcgacgtcggcccctggaacagggctttggagttgagtcggatgactcgacctagagcggtcgactacgaaagtctcgacaacgtaggacgttagaggaccgtaaggcaaccgagacgaacggacggacaacctccgaancgacgtccgactacgacaccgacgacctaacgacgacctacggacggtacgtaccgtaggaccggaccggtacgaaggtaaccgacgtaccgacggaacgtacggacgtaacgtacgtacgtacgtacgacgacgagtag

SEQ ID NO: 402547 - DNA, 526 bp, Homo sapiens
  misc_feature: GZ8MTXP02G0T89.4.37.D04.1.454.CMB.2.raw
  modified_base (251)..(251): a, c, t, g, unknown or other
  modified_base (351)..(351): a, c, t, g, unknown or other
  modified_base (368)..(368): a, c, t, g, unknown or other
  modified_base (451)..(451): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctctgcaaggcttnggataccaccttcacccgcctactatatgcagtgggtgcgacgtcggcccctggacgaagggcttaggagttggagtgggatggaccgtccgaacctagnggcggagacacaaaatntcgacagtaagtagttcgaggcaggtcacgatgacgacggacacgcacgtcacgacacgtaccatcacgacactacgacctanacgtggacctggacgtccgctagacagtcgacgaccgacgaccgtaacgtattacgttcgagtcggagagggtag

SEQ ID NO: 402548 - DNA, 602 bp, Homo sapiens
  misc_feature: GZ8MTXP02JEHTF.4.37.D04.1.454.CMB.2.raw
  modified_base (254)..(254): a, c, t, g, unknown or other
  modified_base (261)..(261): a, c, t, g, unknown or other
  modified_base (584)..(584): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaaggtctcctgcaaggcttcnggatacnccttcaccgcctactatatgcacgtgggtgcgtacgtcggccccgtggacaagggtcctttaggaggtggagtggggatgggaaccttccgaacccctaagacggcggtacgggacctaagaaagtatcggaccacgtaaggtaaacggttcgaacgggggctaacggggtccaacgacgtagacccgaggggacaccggtacagtcgagcctacgtccaagtccgagaccacgacgccgtaagacgtggacccgtggacggtcccggcgtaggaaccgtacgccggtacgaaccgacggtaccgcgtaacgttacgtttcgnggtacgacggtaggtacg

SEQ ID NO: 402549 - DNA, 656 bp, Homo sapiens
  misc_feature: GZ8MTXP02F3Y1J.4.37.D04.1.454.CMB.2.raw
tcagagcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggacgcccactcccgaggtgcagcgtggtgcaggtcgtggggctggaggtagaagagccgtggggcctgagtgaggtctcgtgcgaaggtcttgaggactaccaccttccaccgtaccttaactatagtcgactacggtggggtcgccggacgtccggacccccgtagggaccgtaacggggtcttaggagggtggaggtggggatggaacctccgaacctagcggacgggtaggaaccacggtaaagtacgtacgggacctaacgtaaggtttaacggttacggaaacggggtcgtaacgggtacccaaacgtaggtaccggaaaccgacggggtaaccaccggtaccaacgtcgaacggccaaccgtacgtaacacgaacgaccaaaccgtcgaccgtaacgacggtacgaccgtggacgggccgtcgtacggacgtacgtacgacggaccgacgacgtaacgtacttagtcgtaggtgacggaggagg

SEQ ID NO: 402550 - DNA, 715 bp, Homo sapiens
  misc_feature: GZ8MTXP02I01YR.4.37.D04.1.454.CMB.2.raw
  modified_base (543)..(543): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtgggctggaggtgaagagccgtgggcctgagtgagtctcgtgcgaagtctcgtgataccaccttccacccgcctaactatactcgaccgtacggtgggtcgaccgaccggtccggacccccgtgggaaaccgaacggggtctttagggaggtgggaaggttggggagttggaaccgtacccggaacccgtaacgagggcggttacggaaccaagtaaagttagtacgaccgaaagtaacggtaaacgtttcgggaacggggtacgtacgggtaccaaccgagtaaccggaccggaacgggaccaacccgacccgagtaccgacggaacccgaaccgttacccaanacccgaacgacccaaaccgtcgtacccgtaacgtacgtaccgggaacctacggggaccgtccggaccgttaccggaaacttacggttaaccgtacgggaaaacccgacccgtaacggtcccgtttaaaattccggttttaccggacgggtaccggacggggtaaggtacggg

SEQ ID NO: 402551 - DNA, 634 bp, Homo sapiens
  misc_feature: GZ8MTXP02H2CUX.4.37.D04.1.454.CMB.2.raw
  modified_base (251)..(251): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtggggcctgagtgaggtctctgcaggcttcgnggataccaccttcacccgtacctactatatgaccgacgtggggtcgccgtacgtcgggcccccgtaggaacgaaggggtcttaggaggtggaagtggggagtaggacctaccggaaccctaagacggtcgggtacggacaacgtaaaaggttagacgacctaacgaagggtaaacgtttcggaacgggacggacgggtaccaaccgtagaccgaaccgaacgggaaccaaccggtaccacgtaccgaacgaccgtaccgtacctaacgaccgaacgaccaacgaaccgacccttaacgacgtacggaccgtacggacggtccggacgtacggactacgacgacgacgtacgacgtccgtatacgtcgagtcggacgtaggagg

SEQ ID NO: 402552 - DNA, 541 bp, Homo sapiens
  misc_feature: GZ8MTXP02IKEU3.4.37.D04.1.454.CMB.2.raw
  modified_base (252)..(252): a, c, t, g, unknown or other
  modified_base (370)..(370): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactccccaggtgcagctggtgcagtctggggctggaggtgaagaagccgtggggcctcagtgaaggtctcctgcaaggcttcnggatacaccttcaccgctactatatcgcacgtgggtgcgactcggccccgtggacgaagggtcttaggaggtggagtggggatggactcccgaaccctaagagcggtggacaacagtntgacacagtaagtttcgagggcgaggtcaccagtagaccgagggaccacgtaccatcacgtcaccgtacgactcagccaacacgacctacagtcgacctggaacgccggtactacgacacgtacgacgacgtacgacgtacgtaagtacttcgcgtagcggacggtagagg

SEQ ID NO: 402553 - DNA, 554 bp, Homo sapiens
  misc_feature: GZ8MTXP02JLPVI.4.37.D04.1.454.CMB.2.raw
  modified_base (293)..(293): a, c, t, g, unknown or other
  modified_base (333)..(333): a, c, t, g, unknown or other
  modified_base (369)..(369): a, c, t, g, unknown or other
  modified_base (482)..(482): a, c, t, g, unknown or other
  modified_base (509)..(509): a, c, t, g, unknown or other
  modified_base (542)..(542): a, c, t, g, unknown or other
tcagagcactgtagcacgaccggtgctcgatttagtagcatactggttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaacgccgtggggcctgaggtgaacggtctctgacaaggcttctgggatacaccttcaccgctactatatgcacctgggtncgactggcccctaggacagggctgagtgatcgggatcggntccgaccctaagacgcggtggacctaagaaaggttncgggacaccgaagtaacgttttcgaagggtcccgagggttaccaaccagttgaaccgagggacctaacgtcccaagccgaagccgtacttcaactcaggacacacgtcctaanagtcggaacctgaacgcggcgtacganaacggcagaccgagacgacctaagtacttcggngcgcgagagtag

SEQ ID NO: 402554 - DNA, 518 bp, Homo sapiens
  misc_feature: GZ8MTXP02I7BH3.4.37.D04.1.454.CMB.2.raw
  modified_base (226)..(226): a, c, t, g, unknown or other
  modified_base (249)..(249): a, c, t, g, unknown or other
  modified_base (336)..(336): a, c, t, g, unknown or other
  modified_base (352)..(352): a, c, t, g, unknown or other
  modified_base (479)..(479): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctnagtgaaggtctctgcaagcttcnggatacaccttcaccgcctactatatgcacgtgggtgcgactcggcccctggacgagggcttgagtggatggatggactcgacctangcggtgacacaaagtntgacacgagtaaagttcagggcgagggtccaacgagtacgacgacggggacacgtaccatcacgcacgtccatcagacacagacctacgagtcggacctggacggccggctaggacctagtacccgngacgacgacggtcgtaattcgttacgtgtcgcggaggag

SEQ ID NO: 402555 - DNA, 510 bp, Homo sapiens
  misc_feature: GZ8MTXP02JWENI.4.37.D04.1.454.CMB.2.raw
  modified_base (247)..(247): a, c, t, g, unknown or other
  modified_base (336)..(336): a, c, t, g, unknown or other
  modified_base (352)..(352): a, c, t, g, unknown or other
  modified_base (440)..(440): a, c, t, g, unknown or other
  modified_base (470)..(470): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctctgcaggctcnggatacaccttcaccgcctactatatgcacgtgggtgcgactggcccctggacaagggctggagtggagtggatggactcgacctaagngcggtgcacgaaagtntgacacagtagtttcgagggcgacgggtcacgagtacgacgagggacacgtacactacgacgcacgtccatcagacaccgacgccacngtcggacctgacgcggcgtagacacgtacncgacgacacggtaacctagtacttgcgtagcggtaggagg

SEQ ID NO: 402556 - DNA, 583 bp, Homo sapiens
  misc_feature: GZ8MTXP02FOSWU.4.37.D04.1.454.CMB.2.raw
  modified_base (349)..(349): a, c, t, g, unknown or other
  modified_base (568)..(568): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctcagtgaaggtctcctgcaaggtcttctggataccaccttcaccgcctactatatgcagtgggtgcgacgtcggcccctggaccgaagggtcttgaggtggagtgggatggactccgacctaagnggcggtgacacgaaagtatcgacacaagtaagttcgaaggggcgacgggtacaaccgagtacgaaccgacggggaacctaccggtaccaagtcacgacctaccgtaccactccaacgaccaaccgacgtacccaacgtacgtaccggaaccgtcggacggccggccgtacggacgtactaccgtacgaccgaccggaccggtaaccgtattacgttcgngtcggacggaggagg

SEQ ID NO: 402557 - DNA, 550 bp, Homo sapiens
  misc_feature: GZ8MTXP02FOGB5.4.37.D04.1.454.CMB.2.raw
  modified_base (253)..(253): a, c, t, g, unknown or other
  modified_base (367)..(367): a, c, t, g, unknown or other
  modified_base (471)..(471): a, c, t, g, unknown or other
  modified_base (490)..(490): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccgcctactatatgcacgtggtgccgacgtcggcccctggacaagggcttgaggtggatgggatggactaccgacctaacgaggcggtagacacgaaagtntgcacgaagtaacgtttcgaggcgaggtaccacgagtcgacgacgggaccacggtccacgtcacgtcgacgtaccgatacacgcaacgtacgacctacgtacgnggtaacctgacgcggaccngacactcgtacgaccgtacgaccggtaacgtacgttactttcgaggtcgacggaggtagg

SEQ ID NO: 402558 - DNA, 530 bp, Homo sapiens
  misc_feature: GZ8MTXP02F4ICM.4.37.D04.1.454.CMB.2.raw
  modified_base (227)..(227): a, c, t, g, unknown or other
  modified_base (512)..(512): a, c, t, g, unknown or other
  modified_base (523)..(523): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaaggtctcctgcaaggcttctggatacaccttcaccgcctactatatgcacgtgggtgcgactcggcccctggacgaagggcttgagtggagtgggatggactcgaccctaagaggcggtggcacgaaagtatgacaacgagtaagtttcgaggggcgagggtcaaccgatgaccgagggacacgtccatcagccacgtcagtacacgcaacacgacctacacgtcggaccgtgaacggccggctacggacgtacggaccgtacgaacgacgacgaacgtntattcgagcgnggaggag

SEQ ID NO: 402559 - DNA, 503 bp, Homo sapiens
  misc_feature: GZ8MTXP02I4GAB.4.37.D04.1.454.CMB.2.raw
  modified_base (163)..(163): a, c, t, g, unknown or other
  modified_base (243)..(243): a, c, t, g, unknown or other
  modified_base (246)..(246): a, c, t, g, unknown or other
  modified_base (264)..(264): a, c, t, g, unknown or other
  modified_base (273)..(273): a, c, t, g, unknown or other
  modified_base (351)..(351): a, c, t, g, unknown or other
  modified_base (454)..(454): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccanaggagcccactcccaggtgcagctggtgcagtcgtgggctggaggtgaagagccgtgggcctgagtgaggtctctgcagntcngatcacttcacgctatantgcagtggncgacgtcggccccgtggacgaggcttggagtggagtggagtggactacgacctaagaggtcggtaggacacgaaagtntgacagtagagttcgaggcgaggtcacgagtacgacgacggacacgtcacgtgacgcacgtcatcagacacgcgtacatagacgactagacgcggactagacnctacgacgaccgacgagtccgtaatcgttcgaggtcgacggaggtaagg

SEQ ID NO: 402560 - DNA, 621 bp, Homo sapiens
  misc_feature: GZ8MTXP02I9ZKP.4.37.D04.1.454.CMB.2.raw
  modified_base (225)..(225): a, c, t, g, unknown or other
  modified_base (250)..(250): a, c, t, g, unknown or other
  modified_base (277)..(277): a, c, t, g, unknown or other
  modified_base (286)..(286): a, c, t, g, unknown or other
  modified_base (602)..(602): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtgggcctnagtgaggtctcctgcaaggcttcgngactactaccttcacccgctactatangcagtgggncgacgtcggcccgtggacgacggtcgtgagtggagtgggagtgacgtaccgacctaacgacggcggtacgacacgtaaagtaagtcgacgaagtaaggtaaagtttacgaaggggctaacggggtcaaacccgagtacgaaacgaccggggtaacacccggtaccatcgaacgaccgaaccgtaccaagccaacggacccaaaccggacaaacccgttacgaaacgtccgggtaaacccgcgggaccggtaccggtacgtacgaaaccggtacgtaccgacggaaaccgtacgacggtaacgttaacttcgtacgnggtacggacggaggtacgg

SEQ ID NO: 402561 - DNA, 529 bp, Homo sapiens
  misc_feature: GZ8MTXP02GRE5Q.4.37.D04.1.454.CMB.2.raw
  modified_base (245)..(245): a, c, t, g, unknown or other
  modified_base (248)..(248): a, c, t, g, unknown or other
  modified_base (250)..(250): a, c, t, g, unknown or other
  modified_base (256)..(256): a, c, t, g, unknown or other
  modified_base (260)..(260): a, c, t, g, unknown or other
  modified_base (264)..(265): a, c, t, g, unknown or other
  modified_base (324)..(324): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctgagtgaggtctctgcagctngancnctcacnctanatanncagtggtgcgactcggcccctggacgaggctgagtggatgggatggactccgacctagnggtcggtagcacgaagtatgacagagtaagtttcgagggcgacggtcacgagtcgaccgagggacacgtccagtcgagccacgtaccataccgagaccaccgacgaccctacaacgttcggacctaggacggtccggaccgtggaaaccgcgacgtaccgacgacgaccgtaacgtactacgtttcggnggtacgacggtaggag

SEQ ID NO: 402562 - DNA, 570 bp, Homo sapiens
  misc_feature: GZ8MTXP02HPI7K.4.37.D04.1.454.CMB.2.raw
  modified_base (259)..(259): a, c, t, g, unknown or other
  modified_base (398)..(398): a, c, t, g, unknown or other
  modified_base (469)..(469): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtagaagagccgtggggcctcgagtgaaggtctccgtgacgaaggtcttcgnggactaccaccttccaccgtcctaactatactcgactagtgggcgaccgacgtccggcccctagggaacgaaggggtcttggagtggagtgggataggacctaccgaacccgtagacggtcggtagacgactaaaggtnacgacaagtaaggtacgttacggaggacgagacacgagacgacgacggacacacacacgacgaccacgcanacacgaccacgacaccaacgcgtacgacgacgacggccggacgacgacgacgtacgacgacgaccgacgtaacgttacgtcgttcgagcggacggagacgg

SEQ ID NO: 402563 - DNA, 577 bp, Homo sapiens
  misc_feature: GZ8MTXP02HEH2T.4.37.D04.1.454.CMB.2.raw
  modified_base (238)..(238): a, c, t, g, unknown or other
  modified_base (245)..(245): a, c, t, g, unknown or other
  modified_base (251)..(251): a, c, t, g, unknown or other
  modified_base (350)..(350): a, c, t, g, unknown or other
  modified_base (370)..(370): a, c, t, g, unknown or other
  modified_base (446)..(446): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagagccgtgggcctcagtgaggtctcngcagctngatacncctcaccgcctactatatgcacgtgggtcgcgtacgtccggccccgtaggaccgaagggtcttaggaggtggagtggggatggactaccgacctaacgnggtcggtcgacacgaaagtntacgacagaggtacgttacgagggacgaggtacacgagtacgaccgaggaccacgtacactacgagccaacgtcanacagaccaacacgcctagacgtccgacgtaggaccggacgcctacggacctactacgtacgaaccgaccgaaccggggtaacccttaaagttccgtttacggtacggttcggacggggtaacggggtaagg

SEQ ID NO: 402564 - DNA, 525 bp, Homo sapiens
  misc_feature: GZ8MTXP02H36KV.4.37.D04.1.454.CMB.2.raw
  modified_base (182)..(182): a, c, t, g, unknown or other
  modified_base (198)..(198): a, c, t, g, unknown or other
  modified_base (226)..(226): a, c, t, g, unknown or other
  modified_base (245)..(245): a, c, t, g, unknown or other
  modified_base (513)..(513): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtncagctggtgcagtcgnggggctgaggtgaagagccgtgggcctnagtgaggtctctgcagctngatacactcaccgctactatatgcacgtgggtgccgacgtcggcccctggacgagggtcttggagtggagtgggatggactccgacctagagcggtggacacgaaagtatagaccagaagtaagtttcgaggggcagggtacacagtacgaccgagggacacgtacatcgagccacgtcatacacgacaacacgaccgtacacgtcggaccgtaggacgcggtacacggtacacgtacgacgacgtacgacggaacgtactattcggngcgacgacggag

SEQ ID NO: 402565 - DNA, 501 bp, Homo sapiens
  misc_feature: GZ8MTXP02ICAAX.4.37.D04.1.454.CMB.2.raw
  modified_base (254)..(254): a, c, t, g, unknown or other
  modified_base (345)..(345): a, c, t, g, unknown or other
  modified_base (362)..(362): a, c, t, g, unknown or other
  modified_base (406)..(406): a, c, t, g, unknown or other
  modified_base (417)..(417): a, c, t, g, unknown or other
  modified_base (500)..(500): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttcgnggataccaccttcacccgtcctactatatgctacgtgggtgcgactcggcccctggacgaggcttgagtgagtggatggactcgacctagngcggtcgcacaaagtancgacagagtagtcgagcgacgcacagcgacgacggacacgacancacgcacacanacacgacacacgactacgacgtacgacgcgacgcggacgacggacacggcgacgacgacgacgtgtctacgtcgtgcgcgagng

SEQ ID NO: 402566 - DNA, 517 bp, Homo sapiens
  misc_feature: GZ8MTXP02I5UKA.4.37.D04.1.454.CMB.2.raw
  modified_base (230)..(230): a, c, t, g, unknown or other
  modified_base (507)..(517): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctggaggtgaaggaagccgtggggcctnagtgaaggtctctgtaaggcttctggatacaccttcaccgcctactatatgcactgggtcgcgacgtcggcccccgtggacgaaggggcttgaggtggagtgggatggatccccgaccctaacaggcggtggcaacgaagtatggacacaagtaacgtttacgagggacgagggtacacgatacgaaccgaggacacgtaccatacagcacgtccatcagacaacacgcctaacagtcggaccctggacgcgggcgtaggacgaggaccgcacgagnnnnnnnnnnn

SEQ ID NO: 402567 - DNA, 517 bp, Homo sapiens
  misc_feature: GZ8MTXP02H5RUE.4.37.D04.1.454.CMB.2.raw
  modified_base (239)..(239): a, c, t, g, unknown or other
  modified_base (283)..(283): a, c, t, g, unknown or other
  modified_base (356)..(356): a, c, t, g, unknown or other
  modified_base (421)..(421): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatccttcttcttggtggcagcagccacaggagcccactcccaggtgcagctggtgcagtctggggctgaggtgaagagccgtgggcctgagtgaggtctccngcaaggctctggatacacctcaccgctactatatgcagtgggtncgactcggccctggacaagggcttggagtgagtggatggactcgaaccctagacggcgtggacactaaaagtnagacaagagtacgttcgagacgacggcacgagacgacgacggacacgacacacgacacacgtcanacacgacacgacgacacgacgtacgacgacgacgacggacgtacgacgacgacgacgacgacgacgtaacgtactactacgtcgtcggacgaggag

SEQ ID NO: 402568 - DNA, 661 bp, Homo sapiens
  misc_feature: GZ8MTXP02HTGQR.4.37.D04.1.454.CMB.2.raw
  modified_base (252)..(252): a, c, t, g, unknown or other
  modified_base (258)..(258): a, c, t, g, unknown or other
  modified_base (274)..(274): a, c, t, g, unknown or other
  modified_base (370)..(370): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaggtctctgcaagcttcngatacnccttcaccgtctactntatgcagtggtgcgacgtcggcccctggaccgaagggtcttaggagtggagtggggatggactccgaaccctagacggcggtaggacacgaaagtntgaccgaatacgggtaaacgtttccgaggggtcgaagggtaccaaacgtacgacgaaaccggaaggggaaccacccggttaccagttaccgacggtacctaaccggtccctaacgaccgacggacccaacgaccggcccttaaacgacgttaccggacccgtagggaccggccggttacccgaggaaacctcgttaaccgtaccggacccggaaacccgaccggggttaaccccggttatttaaaccggttttcgtacgggttccggacgggggttaacggggtaaagggg

SEQ ID NO: 402569 - DNA, 540 bp, Homo sapiens
  misc_feature: GZ8MTXP02HB65Y.4.37.D04.1.454.CMB.2.raw
  modified_base (257)..(257): a, c, t, g, unknown or other
  modified_base (290)..(290): a, c, t, g, unknown or other
  modified_base (342)..(342): a, c, t, g, unknown or other
  modified_base (349)..(349): a, c, t, g, unknown or other
  modified_base (367)..(367): a, c, t, g, unknown or other
  modified_base (468)..(468): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtcgtggggctgaggtagaagaagccgtggggcctcgagtgaaggtctcgtgacaggtcttgngactacacctcaccgcctatatatgcatgggtncgacgtcggccctggacgaggcttgagtggagtggatggactcgaacctagnggtcggngacacgtaaagtagcganacgaaggtacgggttcgggacacggtacacgtagacgaacccgaggaccacgtacagcaacgcaaccgtccagtacacgcaacgcactagagtacgaccgngacgcgacgagactacgtcgacggacgaccgtacgtacgtgttacgttcgtagacggacggtagggagtcgg

SEQ ID NO: 402570 - DNA, 510 bp, Homo sapiens
  misc_feature: GZ8MTXP02FISUO.4.37.D04.1.454.CMB.2.raw
  modified_base (345)..(345): a, c, t, g, unknown or other
  modified_base (362)..(362): a, c, t, g, unknown or other
  modified_base (368)..(368): a, c, t, g, unknown or other
  modified_base (472)..(472): a, c, t, g, unknown or other
  modified_base (495)..(495): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcacccgcctactatatgcacgtgggtgcgactcggcccctggacaagggctgagtggagtggggatggactccgaccctaanaggcggtgcacaaagtntgcaanagtaagtttcgaaggggcaggggtcaccgagtcgaccgagggacacgtccatcagccacgtccatcagcacacgcctacagtcgacgtgagcggctagacatcncgacgacgacgcgtatacttcgngtacggcggaggtag

SEQ ID NO: 402571 - DNA, 558 bp, Homo sapiens
  misc_feature: GZ8MTXP02I4UXW.4.37.D04.1.454.CMB.2.raw
  modified_base (339)..(339): a, c, t, g, unknown or other
  modified_base (358)..(358): a, c, t, g, unknown or other
  modified_base (468)..(468): a, c, t, g, unknown or other
  modified_base (539)..(539): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcgtggggcctcagtgagtctctgcaaggtcttgtggatacacttccaccgcctactatatgcagtggtgcgatcggcccctggacaagggcttgagtggagtgggatggactcgaccctaagnggcggtaggacagaaagtntggacacgtaagtaagtttcgaagggcgtacgggtacaaccgatcggaaccgtaggggacaccggtaccagtacacgtacccacggtccaatccgaagccactacgctanacgtggacctgacgcggctagactactcgtacgaccgaacgtacccgggtaacgtaactttactttacggnggtacggacgggacggtag

SEQ ID NO: 402572 - DNA, 576 bp, Homo sapiens
  misc_feature: GZ8MTXP02H74LJ.4.37.D04.1.454.CMB.2.raw
  modified_base (143)..(143): a, c, t, g, unknown or other
  modified_base (224)..(224): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctnttcttggtggcagcagccacaggagcccactcccaggtgcagctggtgcagtctggggctgaggtgaagagcgtgggcctnagtgaggtctctgcaggcttctggatacaccttcaccgcctactatatgcacgtgggtgccgactcggccccctggacgaagggcttgagtggagtgggatggactaccgaccctacgaggcggtaggacacgaaagtatcgacacgagtaggtttcgaaggggtcgagggtcacgagtcgaaccgacggggtacaccgttccgaacgtcgaacggtcccaaccggtacccaacgtacccgagacccaaccgacggaccctagacgtcggaccgtgacggtcggacctggacagtccgtacgaaccgtaggaccggtccttagttaacgttcgtggtacggacggaggtagg

SEQ ID NO: 402573 - DNA, 517 bp, Homo sapiens
  misc_feature: GZ8MTXP02G67XX.4.37.D04.1.454.CMB.2.raw
  modified_base (292)..(292): a, c, t, g, unknown or other
  modified_base (350)..(350): a, c, t, g, unknown or other
  modified_base (368)..(368): a, c, t, g, unknown or other
  modified_base (431)..(431): a, c, t, g, unknown or other
  modified_base (445)..(445): a, c, t, g, unknown or other
  modified_base (504)..(504): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcgtgcaaggtctcgtggactacaccttcaccgtcctactatatgcagtggngcgacgtcggcccctggacgaaggtcttggagtggagtgggatggactcgacctaagnggcggtgacacgaaagtngacacgagtagtttcgaggcgaggtccacgagtacgacgacgggacacgtcatcagcacgcancacgcacgagccangtcgaccgtgacgaccggcgtacgacgacgtcgacgacgacgacgtcgtactacgttcngtacgcggagagg

SEQ ID NO: 402574 - DNA, 687 bp, Homo sapiens
  misc_feature: GZ8MTXP02JEVDC.4.37.D04.1.454.CMB.2.raw
  modified_base (182)..(182): a, c, t, g, unknown or other
  modified_base (249)..(249): a, c, t, g, unknown or other
  modified_base (285)..(285): a, c, t, g, unknown or other
  modified_base (299)..(299): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggacgcccactcccaggtncagcgtggtgacaggtcgtggggctggaggtagaagacgccgtgggcctagagtgaacggtctccgngcaaggtcttcgtaggactacctaccttccgacccnccttaactatacgngcctacggtgggtcgaccgtccgtccggccccgtaggaccgaagggtccgttaggaggtggaagttggggatacggaccgtacccggtaaccccgtaagacgggtccggtacggaaccagtaaagttcgacgaccctaagtaacggttaaagttcggaaacggggcgtaagggtacccaacgtacgttccgggaacccgacggggaacctaccggttaaccacgtacaaaccgggccctaaacggttcccagacacggaccctaccgaacgtccctaagacggtaccggacgtacggcggcggtccgtagaacccgtaggtacccgagtaaacggtcccgaggtaaccttcgttagttaccgttacgggtacggtacggtacggtagg

SEQ ID NO: 402575 - DNA, 516 bp, Homo sapiens
  misc_feature: GZ8MTXP02JGYY5.4.37.D04.1.454.CMB.2.raw
  modified_base (291)..(291): a, c, t, g, unknown or other
  modified_base (328)..(328): a, c, t, g, unknown or other
  modified_base (352)..(352): a, c, t, g, unknown or other
  modified_base (467)..(467): a, c, t, g, unknown or other
  modified_base (486)..(486): a, c, t, g, unknown or other
  modified_base (506)..(516): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctggaggtgaagaagccgtggggcctgagtgaggtctcctgcaaggcttctggatacacccttcacccgcctactatatgcacgtgggngcgactcggccccctgggacaagggtcttggagtggngtgggatggatccgaaccctaagnggcggtgacacgaaagtcgtgaccagaagtaacgtttcggaaaggggcaaggggtcaccagtacgaccgaggacctacgtcatcgagccaacgtccatacagacacacgcccaanagtcgacctggacgccggngaggacgaaggtcgatacgnnnnnnnnnnn

SEQ ID NO: 402576 - DNA, 575 bp, Homo sapiens
  misc_feature: GZ8MTXP02FLGLZ.4.37.D04.1.454.CMB.2.raw
  modified_base (230)..(230): a, c, t, g, unknown or other
  modified_base (254)..(254): a, c, t, g, unknown or other
  modified_base (318)..(318): a, c, t, g, unknown or other
  modified_base (556)..(556): a, c, t, g, unknown or other
tcagagcactgtagcacgaccggtgctcgatttagtagcatactgttggggtttgggggagcatcacccagcaaccacatctgtcctctagagaatcccctgagagctccgttcctcaccatggactggacctggaggatcctcttcttggtggcagcagccacaggagccccactcccaggtgcagcgtggtgcagtcgtggggctggaggtgaagagccgtgggcctnagtgagtctctgacaggtcttcgngactaccacctcaccgctactatatgcacgtggtcgcgacgtcggcccgtggacgagggtctgnggtggagtggatggactaccgaacccaagcggcggtacgacacgaaagtgagacacgtaaggtagttcggagggcgtaggaccagcgaggacccgagggaccaccggtacacgtacgacgaccaccgtccagtccgagaccaccgtacgtcctaacgacgttccggacgtcggacggtcccggtacgaggaaccagtccgacgaacggaccgtacggtaaccgttattaccgttcggnggtacggacggagggtagg

SEQ ID NO: 402577 - DNA, 666 bp, Homo sapiens
  misc_feature: GZ8MTXP02FK59V.4.37.D04.1.454.CMB.2.raw
  modified_base (255)..(255): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagacgccgtggggcctgagtgaggtctctgcgaaggtcttgngactaccaccttcaccgcctatatatgctacgtggcgcgacgtcggccccgtaggaacgaagggtcttggaggtaggagtgggtatggacctaccgaaccctaacgaggcggtacggacaacgtaaagtatacgaccgtaagtaaggtaaacgtttcggaacggggtcgtacgggtaccaacgtagtaacgggaaaccgaccgggaccgtacgttacgactacgaacgaccgacgtacccagaccgacggaccaaaccggacgtaaccctacgtacggtaccggtaccgtacgggaccggtcccggtaccgtacggaaacctcgtaaccggtaccgaaccggtaaccgtaccggggttaaccttaagtttacgtttaccggagggtacgggtaacggggtaacgggtacgg

SEQ ID NO: 402578 - DNA, 676 bp, Homo sapiens
  misc_feature: GZ8MTXP02GB9F5.4.37.D04.1.454.CMB.2.raw
  modified_base (268)..(268): a, c, t, g, unknown or other
  modified_base (499)..(499): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacgaggacgcccactcccgaggtgcagcgtggtgcaggtcgtggggctggaggtagaagacggccgtcggggcctcgaggtgaacggtctccgtgcgaaggtccttgnggactaccaccttaccacccgtcctaagtatacgtcgacacggttgggtcgaccgtaccgtccggacccccgtagggaacggtaacgggtcttagggagggttggtaaggtggggagttacggaccgttaccccgacccgtaagaccgggtggacgactaacgaagtcagacgaacgtaaggttaacgttcgagggtacgacgtaccaacgatacggaccgaagggtaccnccgtacataccgacgacccgtacgtaccacgtaccgaaccgacaaaccgtccggtaacctacgaacggtaccggtccgaagggccggtcccggacgtacgaacgtaacgttcgaaccgaaccgtacgtaccggtaacctttaagtactttaccgggtcggacggtacggaggtacgg

SEQ ID NO: 402579 - DNA, 566 bp, Homo sapiens
  misc_feature: GZ8MTXP02IUR4X.4.37.D04.1.454.CMB.2.raw
  modified_base (237)..(237): a, c, t, g, unknown or other
  modified_base (247)..(247): a, c, t, g, unknown or other
  modified_base (346)..(346): a, c, t, g, unknown or other
  modified_base (370)..(370): a, c, t, g, unknown or other
  modified_base (456)..(456): a, c, t, g, unknown or other
  modified_base (550)..(550): a, c, t, g, unknown or other
  modified_base (565)..(565): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagagccgtgggcctgagtgagtctcngcaggtctcngatacactcacctcctatatatgctaggtggtgccgtacgtcggcccctagggaccaggtcttgaggtggagtggggatggacctccgaaccgtaacgngggacgtaggactaagtaaacgtntacgcaaagtaggtaacgtttcgaggggcgtaggacaacgacgtacgggaccgaggaccaccgtacactcgacgcaccgtcccaanaccacgacacgtacctacacggtacgaccgtagacgtccgggacgtacgacgacggtccgacgaaacgtacgaccggtacgtaatactttcggngaggacggacgaggng

SEQ ID NO: 402580 - DNA, 512 bp, Homo sapiens
  misc_feature: GZ8MTXP02HCHTQ.4.37.D04.1.454.CMB.2.raw
  modified_base (182)..(182): a, c, t, g, unknown or other
  modified_base (226)..(226): a, c, t, g, unknown or other
  modified_base (315)..(315): a, c, t, g, unknown or other
  modified_base (339)..(339): a, c, t, g, unknown or other
  modified_base (356)..(356): a, c, t, g, unknown or other
  modified_base (382)..(382): a, c, t, g, unknown or other
  modified_base (399)..(399): a, c, t, g, unknown or other
  modified_base (411)..(411): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtncagctggtgcagtctggggctgaggtgaagagccgtggggcctnagtgaaggtctcctgcaaggcttcgtggatacaccttcacccgctactatatgcacgtggtgcgactcggcccctggacaagggcttgngtggatggatggactcgacctaangcggtgcacgaaagtangacagagtagttcgagcgaggcacanagacgacgacacgacanacagcacgacanacacacacacgacctacgacgtacgacgtaggacggtacggcgtacgacgacggacgacgaacgaacgacgaacgtacgtacgtacgtagacgacgaggag

SEQ ID NO: 402581 - DNA, 632 bp, Homo sapiens
  misc_feature: GZ8MTXP02JDL2F.4.37.D04.1.454.CMB.2.raw
  modified_base (253)..(253): a, c, t, g, unknown or other
  modified_base (537)..(537): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaagtctcctgcaggcttcnggatacaccttcaccgcctactatatcgctacggtgggtcgccgacgtcggcccccgtggaacgaaggggtcctttaggaggttagggagttggggatgggaccctaccgaacccgtaacgacgggccggtaggaccaacggtaaaagtcgtagaccgaacgaaggttaacggtttcgaacggggcgtaacgggtccaaccgtagcggaaccgaggggaccacggtcacgtcagccacgtacacacgacgtaccaaccgcgacctacgacgtacggtaacccgngaccggtccggtactacgacgtacgtaccgtacggaccgtaccgtaccggtaacgttacgttcgtttacgaggtacggtacggggtaaggtacgg

SEQ ID NO: 402582 - DNA, 560 bp, Homo sapiens
  misc_feature: GZ8MTXP02FKRPF.4.37.D04.1.454.CMB.2.raw
  modified_base (253)..(253): a, c, t, g, unknown or other
  modified_base (371)..(371): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagagccgtggggcctcagtgaaggtctcctgcaaggtcttcnggatacaccttcaccgctactatatgcacgtggtgcgacgtcggcccctaggacgaagggtcttagaggtggagtgggatggactccgaccctaagaggtcggtaggacacgaaagtngaccactaaggtaagtttcgagggcgacgggtcaccgatcgaccgaggacacgtacatcgacgcacgtcatcagacacacgtacctaacagtcgaaccgtggaacgccgggtacacggacacgttaccgacgaaccgacgaccggtaaccgttaattaacgtttcgaggttacgacgggagggtaaagg

SEQ ID NO: 402583 - DNA, 535 bp, Homo sapiens
  misc_feature: GZ8MTXP02IL2HM.4.37.D04.1.454.CMB.2.raw
  modified_base (227)..(227): a, c, t, g, unknown or other
  modified_base (448)..(448): a, c, t, g, unknown or other
  modified_base (464)..(464): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaaggtctcctgcaaggcttctggatacaccttcaccgcctactatatgcacgtggtgcgactcggcccctggacgaaggcttggagtggagtgggatggactcgacctaacgagcggtaggacacgaaagtatggacacgtagtaacgtttcgagggcgagggtacacgatacgacgagggacacgtaccatcagccacgtccatcacgacaccganacctacagtcggaccngacggcgcccgtgactactcgcgaacgacaccgggaaccgttattactttcgtaggtcgacggagggaagg

SEQ ID NO: 402584 - DNA, 610 bp, Homo sapiens
  misc_feature: GZ8MTXP02HDUV8.4.37.D04.1.454.CMB.2.raw
  modified_base (269)..(269): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagcgtgggctcgagtgagtctctgcagctcgtggatacgacctcaccgcctactatntgctagtggcgcgacgtccggccccgtaggaacgaagggtcgttgaggtggagtgggagtggactaccgaaccctacgacggtcggtacggacaacgaaaagttagcgacaacgtaaggtaacgtttacgagggacgacggtaccaacgtagtacggaaccgaggaacccgaacggtaccaagtaccgaaggaccctacggtacctacgtacacggacaaccgtaacgcctaacgtacgtacggacccgtaggaaccggcgggtacgtacgggacctaacgggttccgaacggtaacgacgtaccggaacttaacgtagtaccgtggccgacggaggaagg

SEQ ID NO: 402585 - DNA, 587 bp, Homo sapiens
  misc_feature: GZ8MTXP02FT3UP.4.37.D04.1.454.CMB.2.raw
  modified_base (191)..(191): a, c, t, g, unknown or other
  modified_base (246)..(246): a, c, t, g, unknown or other
  modified_base (285)..(285): a, c, t, g, unknown or other
  modified_base (509)..(509): a, c, t, g, unknown or other
  modified_base (575)..(575): a, c, t, g, unknown or other
tcagagcactgtagcacgaccggtgctcgatttagtagcatactgttggggtttgggggcatcacccagcaaccacatctgtcctctagagaatcccctgagagctccgttcctcaccatggactggacctggaggatcctcttcttggtggcagcagccacaggacgcccactcccaggtgcagctggtncagtcgtggggctgaggtgaagagccgtgggctcagtgagtctctgcaagcttcnggatacacctcaccgtcctactatatgacacgtgggtancgactcggcccctaggacgaagggtctttaggaggtggtagtaggggagtacggacttaccccgaacccgtaaagcgggtacgggtaggacctaaacgtaaggtatcggaacaaccgtaagttaacggtttacggacggggtaccgtacgggtaccaaccgtaagacgaacgtacggacctacgtaccatacgacgacaccgtcagtcacgacacgacgctacngtacgacaggacgacgctagactacgtacgacgacgtacgacggtacctaagtcttacgagtacgnggaacgagtagg

SEQ ID NO: 402586 - DNA, 562 bp, Homo sapiens
  misc_feature: GZ8MTXP02JUY99.4.37.D04.1.454.CMB.2.raw
  modified_base (247)..(247): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctcgagtgagtctctgcaggctntggatacaccttcaccgcctactatatgcacgtggtgcgacgtcggcccctggacgaggtcttggagtggagtgggatggactacgaccgtaagcggcggtgacgacgaaagtagcgacagagtagttcgagggcgaggtcacgagcgacgacggacacgacatcacgcacgtccatcgacgccacgacgacctacgagtaccggaccgtaggaccggtccggtaccgtacgacgtacgtccggtacggaccgaaccggacggtaaccgttacgtttaacgtttcgtccggtaggtacggggacggggtaagggg

SEQ ID NO: 402587 - DNA, 653 bp, Homo sapiens
  misc_feature: GZ8MTXP02HHIY0.4.37.D04.1.454.CMB.2.raw
  modified_base (265)..(265): a, c, t, g, unknown or other
tcagagcactgtagcacgaccggtgctcgatttagtagcatactgttgggtttgggggagcatcacccagcaaccacatctgtcctactagagaatcccctgagagctccgttcctcaccatggactggacctggaggatcctcttcttgggtggcagcagccacgaggacgcccacctcccaggtgcagctggtgcagtcgtggggctggaggtgaaggaagccgtggggcctcgagtggaaggtctcctgcgaaggtcttcgnggactactaccttccaccgtcctactactatgctacgtgggtcgcgtacgtcggcccctaggaacgaaggggtcgtaggaggtgggaagttcgggagtggaaccctaccggaacccgtaaacgcgggcggggtacggaactacgtaaaacgtcgtacgggacaaccgtaaagggtaacgtttaccgggaggggtcgaacggggtaccaacgtagacgaccgaaacggggactaccggtaccacgtcgaacgactaccgccaagtccacgacacctacgaccctagaacgtcggacccgtagaccggaccggccgttagaccgaactcggaaacgaccgtaaccggacggtaacccgttaatccggttgtacgtcggacgagggtacgg

SEQ ID NO: 402588 - DNA, 690 bp, Homo sapiens
  misc_feature: GZ8MTXP02FWZWJ.4.37.D04.1.454.CMB.2.raw
  modified_base (227)..(227): a, c, t, g, unknown or other
  modified_base (251)..(251): a, c, t, g, unknown or other
  modified_base (290)..(290): a, c, t, g, unknown or other
  modified_base (668)..(668): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagagccgtggggcctnagtgaggtctctgcaaggcttcgnggataccaccttcaccgctactatatgctacgtgggtcncgacgtcggccccgtggaccgaaggggcttaggacgggtggtagtggggattggggaacccttacccggaaccccgtaaagacggtccgggtaggactaaccgaaaggtactacggacctacgtaaagggtacggggtttccgggggcgtaacgggggttacccaacccgtacgttaacgggaacccgggtaaacgggaacccgtaaccggtaccctacgttaacccgaacggtacccgaaacccgttaccgaactacccgaacggacccaaccgaccgtacccttaaacgagtaccggaccgtagggaaccggccggtaccgtacggactaacgtacgtacgaacccgaccgaccgttacgttaacgtactttcggnggtacggacggacggacgtagg

SEQ ID NO: 402589 - DNA, 610 bp, Homo sapiens
  misc_feature: GZ8MTXP02J02S9.4.37.D04.1.454.CMB.2.raw
tcagagcactgtagcacgaccggtgctcgatttagtagcatactgttgggtttgggggcatcacccagcaaccacatctgtcctctagagaatccccctgagagctccgttcctcaccatggactggacctggaggatcctcttcttggtggcagcagccacaggagcccactcccaggtgccagctggtgcagtcgtggggctggaggtgaagaagccgtggggcctgagtgaaggtctcctgcaaggtcttctggactacaccttcaccgcctactatatgcacgtgggtgcgacgtcggcccctggacgaagggtcttggagtggagtgggatggactacccgaccctaacgaggcggtagacaacgtaagtgtaggacaacgagtaacgtttacgagggaacgtacggggtaccaaccgagtacggaacgacgggaccaccgtaccactacgaacgaccgaccggtaccagtcgaacgaccaacgtacgaccctaacgacggtcggaacccgtggaaccggtccggtacgtacggaccacgtccgtacgaccgaccgacgtacccgtaagtacgtttacggcggtacggacggacggtacggtagg

SEQ ID NO: 402590 - DNA, 514 bp, Homo sapiens
  misc_feature: GZ8MTXP02GUVR3.4.37.D04.1.454.CMB.2.raw
  modified_base (285)..(285): a, c, t, g, unknown or other
  modified_base (335)..(335): a, c, t, g, unknown or other
  modified_base (349)..(349): a, c, t, g, unknown or other
  modified_base (351)..(351): a, c, t, g, unknown or other
  modified_base (396)..(396): a, c, t, g, unknown or other
  modified_base (403)..(403): a, c, t, g, unknown or other
  modified_base (410)..(410): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcatgggtcncgactggcccctggacaagggcttgagtggatggatggatcccgacctanagcggtgcacagtngnacataagttcagggctaggcacagtagaccgaggacacgtccaancagcacncatacanaccacacgacctacgacgtacggacctggacgaccggtctacggactacgtacgacgacgacgaccggtacctaagttacttacgtcgtacgacggacggagag

SEQ ID NO: 402591 - DNA, 492 bp, Homo sapiens
  misc_feature: GZ8MTXP02F562E.4.37.D04.1.454.CMB.2.raw
  modified_base (227)..(227): a, c, t, g, unknown or other
  modified_base (336)..(336): a, c, t, g, unknown or other
  modified_base (349)..(349): a, c, t, g, unknown or other
  modified_base (352)..(352): a, c, t, g, unknown or other
  modified_base (418)..(418): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctnagtgaggtctcctgcaaggcttctggatacaccttcaccgtcctactatatgcacgtggtgcgactcggcccctggacaagggtcttgagtgatggatgatcgacctangcgtgcacaagtntgnacagtaagttcgaggcaggtcacgagtgaccgaggacacgtcatcagtccacgtcatcacgcaacncgcctacagtggacctgacgcggactagacacgtcgcgaacgactcgaacgtatacttcgaggcggacgaggtg

SEQ ID NO: 402592 - DNA, 613 bp, Homo sapiens
  misc_feature: GZ8MTXP02HXDQ1.4.37.D04.1.454.CMB.2.raw
  modified_base (245)..(245): a, c, t, g, unknown or other
  modified_base (247)..(247): a, c, t, g, unknown or other
  modified_base (251)..(251): a, c, t, g, unknown or other
  modified_base (467)..(467): a, c, t, g, unknown or other
  modified_base (481)..(481): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggctgagtgaggtctctgcagctngntacnctcacgctatatatgctacgtggcgcgactcggacccccgtgacgaagggtcttggaggtggagtgggagtggtacctaccgtaaccccttaacgaggtcggtacggacacgtaaagtatacgacctaacgtaaggtaactttaccggaggggactagggttaccacgagtaaccgacgacggaactaccggtacagcacggactacggtacctanccgaaggcccaacncgtacccgtaacgtcggttacgaacgttacgggaaggttccccggacgttaccgacgtacgggttacacggaccgtacggaaacgcccggtttattaaccgttcggtaagttccgggtaacgacggggaagg

SEQ ID NO: 402593 - DNA, 615 bp, Homo sapiens
  misc_feature: GZ8MTXP02F01YG.4.37.D04.1.454.CMB.2.raw
  modified_base (416)..(416): a, c, t, g, unknown or other
  modified_base (497)..(497): a, c, t, g, unknown or other
  modified_base (547)..(547): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggagatcctcttcttggtggcagcagccacaggacgcccactcccaggtgcagctggtgcagtcgtggggctggaggtagaagaacgccgtggggcctcgagtggtaaggtctcctgcgaaggcttcgaggactaccacccttccacccgccttaactatatgacctagtcgggtgaccgtacgtccgggcccccgtaggaaccgaagggtcttggaggttggacgtaggggtactggacctacccgaacccgtaagacggtcggtacggaccacgtaaaagtntacggaccaaggtaagtaaacggtttacgacgggtaccgacgggtaccaacgtaggtacgaaccgacggacaccgtccaancgaaacgccaacgtcccatacgaacgaccaacacgtaccacagtcgacgnggcgacggctagaccagacgtacgaacgaccacggtaacgttactacttcgaggtcgaggtaggaagg

SEQ ID NO: 402594 - DNA, 663 bp, Homo sapiens
  misc_feature: GZ8MTXP02GIBCC.4.37.D04.1.454.CMB.2.raw
  modified_base (395)..(395): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctcctgacaaggtcttcgtggactaccaccttcacccgtccttaactatatcgcacgtgggtgccgactcggccccgtaggaccgtaagggtcttaggaggtggagtggggatacggacctaccgaaccctagacggcggtcgacacgtaaagtntcgacaacgtaaggttaaacggttcggaaggggacggtacgggtacccaacgtagtaccggaacccggacggggtaaccacccggtacaacgtccgacggtacccaccggtaccaacgtaccgaaccgaccaaccgtaccgtaccctaacgtacggtaccggaccgtacggaccgggtaccggtaccggtacggaccgtaacggtccgtacggaaccgaaccgtacgggtaactaacgttcgttacgtcggtacggcggtacggtagg

SEQ ID NO: 402595 - DNA, 690 bp, Homo sapiens
  misc_feature: GZ8MTXP02JUIYW.4.37.D04.1.454.CMB.2.raw
  modified_base (261)..(261): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagacgccgtggggcctcgagtggaacggtctctgacgaaggtcttcgnggactacctacccttccacccgtcctaacttatacgtcgacctaggtgggcacgaccgtccggacccccgtagggaacgaacgggtcgttggacggtgggaagtgggagtaggaccctaccgaaccctaagacggtacgggtcgaactacgtaaagtcgtagacgaaggtaacgttaacggttcggaagggggtaccgtaggggtaccctaaacggtaacgtacgggaaacccgtacgggggaaccctacggtaccctagaccgaacggaccctaaccgtaccctagtaccgacgtaacccaaccgtaccgaccctaaagtacggtccggaacccgtaggaccggtcccggactacggaaccacgttccgaacggacgtaccgaccgggtaacttagttacgttacggtggtaccgaggggaggtacgg

SEQ ID NO: 402596 - DNA, 534 bp, Homo sapiens
  misc_feature: GZ8MTXP02JOITI.4.37.D04.1.454.CMB.2.raw
  modified_base (282)..(282): a, c, t, g, unknown or other
  modified_base (348)..(348): a, c, t, g, unknown or other
  modified_base (445)..(445): a, c, t, g, unknown or other
  modified_base (510)..(510): a, c, t, g, unknown or other
tcagagcactgtagcacgaccggtgctcgatttagtagcatactgttgggtttggggggagcatcacccagcaaccacatctgtcctctagagaatccccctgagagctccgttcctcaccatggactggacctggagatcctcttctggtggcagcagccacaggagcccactcccaggtgcagctggtgcagtcgtggggctggaggtgaagaagccgtggggcctcagtgaaggtcctctgcaaggcttcgtggactacaccttcaccgcctactatangcacgtggtgcgactcggcccctggacaagggtcttgagtggagtgggatggacgtccgacctacnggcgtggcacgaaagtatcgcaacaagtacgttcgaggggtcaaggggtcaacgagtcgaaccagggaccaacgtcactcacgcacgtccatccganaccacgacgctaaccgatcggacctggacgcgacgtgacacgttcagaccgtacgcggtaacctntacgttgcgtcggacgaggtacgg

SEQ ID NO: 402597 - DNA, 578 bp, Homo sapiens
  misc_feature: GZ8MTXP02FZPLU.4.37.D04.1.454.CMB.2.raw
  modified_base (253)..(253): a, c, t, g, unknown or other
  modified_base (382)..(382): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtgggcctgagtgaaggtctcctgcaaggtcttcgnggatacaccttcaccgtcctaactatatgcacgtgggtcgcgacgtcggcccctgggaacgaaggggtcttaggaggtgggagtggggatggactaccgaaccctaagaggcggtaggacacgaaagtntagacaacgaaggtaagttcgaggggcagggtcacgatcgacgagggacacgtccatcagcacgtccatcaagcacacgtaccacgacgtacggaccgtggacgtccggacctaggacctagttaccgacggaaaccgacggtaacgggtaacccgtttaagttacgttttcgtcggtaggacgggaagggtaagg

SEQ ID NO: 402598 - DNA, 540 bp, Homo sapiens
  misc_feature: GZ8MTXP02FQVNE.4.37.D04.1.454.CMB.2.raw
  modified_base (242)..(242): a, c, t, g, unknown or other
  modified_base (248)..(248): a, c, t, g, unknown or other
  modified_base (254)..(254): a, c, t, g, unknown or other
  modified_base (361)..(361): a, c, t, g, unknown or other
  modified_base (438)..(438): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtgggcctgagtgaggtctctgnagcttngatacncctcaccgcctatatatcgcacgtggtgcgacgtcggccccgtggacgagggtcttggaggtggagtggatggactaccgacctaagcgtggtacgacacgaaagtntacgaccaagaagtaaggtttcgagggacgtacggtacacgagtacgacgagggaccacgtacatcacgcacgtcancagcacgacgtacacgagtcgactaggacgccggacgtgacgtacgtacgtacgaaccgacgaccggtcgtaacgttgttcgtagtacggacggtagggagg

SEQ ID NO: 402599 - DNA, 603 bp, Homo sapiens
  misc_feature: GZ8MTXP02FJMEH.4.37.D04.1.454.CMB.2.raw
  modified_base (262)..(262): a, c, t, g, unknown or other
  modified_base (403)..(403): a, c, t, g, unknown or other
  modified_base (595)..(595): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtagaagaagccgtaggggcctcgagtggaaggtcctccgtgacaaggctttcnggtactacaccttcaccgcctactatactgcacgtgggtcgccgtacgtcgggaccccctggaacgtaaggggtcttaggaggtcggtagtgggagtggactaccgaaccccgtaagcggcggtcggactacgaaagttcngaccaagtaaggtaacgttcgaaggggtcgacgggtaccaaccgagtacgaaccgagggtaccgaaccgtccaacgtcgaaacgtccgaaccgtcagccaagacaaccacggtacctacgacggttacgaccgtcggaacggcccggtacgtcgaacggacgtacgacgaacggcacggctagtacttgagngacgagag

SEQ ID NO: 402600 - DNA, 556 bp, Homo sapiens
  misc_feature: GZ8MTXP02GWEMV.4.37.D04.1.454.CMB.2.raw
  modified_base (197)..(197): a, c, t, g, unknown or other
  modified_base (226)..(226): a, c, t, g, unknown or other
  modified_base (238)..(238): a, c, t, g, unknown or other
  modified_base (246)..(246): a, c, t, g, unknown or other
  modified_base (267)..(267): a, c, t, g, unknown or other
  modified_base (312)..(312): a, c, t, g, unknown or other
  modified_base (342)..(342): a, c, t, g, unknown or other
  modified_base (361)..(361): a, c, t, g, unknown or other
  modified_base (454)..(454): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctggaggtgaagagccgtgggcctnagtgaggtctcngcagctgngatcacctcaccgctactatntcgcacgtggtgccgtactccggcccctggaacgaagggcttagnggtggagtgggatggacgtccgacctacgnggtcggtagcaagtaagtntcgacacgaagtagttacggagggcaggggtcaacgatcggacgacggacaccgtcaacgtcgaacgccaacgtacccataccgagtccaacncggtactacgaacgtcggaaccgcgaacggtccggaacctggaactaacggtccgtaacgacgaccgtaacggcctaatcgttcaggcgacggtaggtacgg

SEQ ID NO: 402601 - DNA, 664 bp, Homo sapiens
  misc_feature: GZ8MTXP02JQ32B.4.37.D04.1.454.CMB.2.raw
  modified_base (255)..(255): a, c, t, g, unknown or other
tcagagcactgtagcacgaccggtgctcgatttagtagcatactgttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctctgcaaggcttcgnggatacaccttcacccgtcctatatagtcgactacggttggggtcgcggtaccgtccggggtaccccccgttaggggaaccggaaacggggttccttaggggtaagggttcggggaaaggtttgggggaagtttcggggaaccgttacccgaaaccccgttaacggacgggtccggggttaggacctaaccggtaaaaggttacgacgtacaaacgtaaggttaaacgtttcggaacggggtaccggaggggttaccacgtacgacggaacgacggggacacggtaccagtcaacggtcacgtccatacgagacacacggacctacgagtacggactggacgtccggactaggacctacgtacgacgacacgaccgaacgtattacgtacgtagtaccgaggaggtagg

SEQ ID NO: 402602 - DNA, 550 bp, Homo sapiens
  misc_feature: GZ8MTXP02HWT9S.4.37.D04.1.454.CMB.2.raw
  modified_base (249)..(249): a, c, t, g, unknown or other
  modified_base (285)..(285): a, c, t, g, unknown or other
  modified_base (346)..(346): a, c, t, g, unknown or other
  modified_base (485)..(485): a, c, t, g, unknown or other
tcagagcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccgcctactatatgcactgggtncgactcggcccctggacaagggcttaggagtggatggggatggatcccggaaccctaacgngcgggtggaccaacaaaggtatgacacgagtaacgtttcgaggggcaaggggtaccaccgaagtcgaaacccgtaggggacctaacgtccgaatcagacaccgttccaatcacgacacacgaccctacagacggtaccnggacgcggactggacagtcacgacgaccacggtccgtaattattcgcgtagacggtaggacgagg

SEQ ID NO: 402603 - DNA, 490 bp, Homo sapiens
  misc_feature: GZ8MTXP02G0B6T.4.37.D04.1.454.CMB.2.raw
  modified_base (341)..(341): a, c, t, g, unknown or other
  modified_base (345)..(345): a, c, t, g, unknown or other
  modified_base (351)..(351): a, c, t, g, unknown or other
  modified_base (355)..(355): a, c, t, g, unknown or other
  modified_base (364)..(364): a, c, t, g, unknown or other
  modified_base (373)..(373): a, c, t, g, unknown or other
  modified_base (387)..(387): a, c, t, g, unknown or other
  modified_base (391)..(391): a, c, t, g, unknown or other
  modified_base (400)..(400): a, c, t, g, unknown or other
tcagagcactgtagcacgaccggtgctcgatttagtagcatactgttgggtttgggggagcatcacccagcaaccatatctgtcctctagagaatccccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctacatatgcactggtgcgactggcccctggacaagggcttgagtggatggatggatcgacctaacagcggngcanaaagangcanagatagagngagacacanagacagacacacanacanacacgacanacacacacacgactacactacgacgacgacgcgccgacgacactactacgacgaacgacgaaccgtactacttacgtcgtcgacgaggag

SEQ ID NO: 402604 - DNA, 525 bp, Homo sapiens
  misc_feature: GZ8MTXP02HJYFH.4.37.D04.1.454.CMB.2.raw
  modified_base (241)..(241): a, c, t, g, unknown or other
  modified_base (250)..(250): a, c, t, g, unknown or other
  modified_base (347)..(347): a, c, t, g, unknown or other
  modified_base (366)..(366): a, c, t, g, unknown or other
  modified_base (438)..(438): a, c, t, g, unknown or other
  modified_base (455)..(455): a, c, t, g, unknown or other
  modified_base (524)..(524): a, c, t, g, unknown or other
tcagagcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaggtctcngcaggctcnggatacaccttcaccgcctactatatgacacgtgggtgcgactcggcccctggacgaagggcttggagtggagtggggatggactccgacctaacgngcggtggacacgaaagtancgacacgagtaagttcgagggcgagggtacacgatacgaccgagggaccacgtaccatcagacacgtccaancacgacacacgacctanagtcggacgtagacgcggactgacacgcgtacgacgacgacgtaacgtatacgttcagtacgcggaggng

SEQ ID NO: 402605 - DNA, 528 bp, Homo sapiens
  misc_feature: GZ8MTXP01AJSKB.8.37.D04.1.454.CMB.2.raw
  modified_base (473)..(473): a, c, t, g, unknown or other
  modified_base (516)..(516): a, c, t, g, unknown or other
  modified_base (522)..(522): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcaggccagtgaaccttttagtagtagttatttagcctggtatcggcaaaactggccaggctccccgactcctcttcttggtggagcctacagggccactggccaccccagacaggatcagtggcaggcgggtctgggacagacttcattctccaccatcaacagaactgcagcctgaagatatgctagtttacactgtcagcagtatgttacgtcccgtgacgttcgaccgaagggggaccaagggtgacaatcgaaccgactgnggtctgcaccaatcttgtcttcgactcttcccgcatctgaacncacgcngcgtgg

SEQ ID NO: 402606 - DNA, 567 bp, Homo sapiens
  misc_feature: GZ8MTXP01CYKOH.8.37.D04.1.454.CMB.2.raw
  modified_base (388)..(388): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggcaaaacctggccaggctccccgactcctcttcttggtggagcctacagggccactggccaccccagacaggatcagtgcaggcggtctgggacagacttcattctccaccatcaacagaactgcagcctagaagntattgactagtttactactgtcagcagttactgttaccgtccccgtaggaccgtttacgggaccgaaagggggaccctaagggtcggacaaacgtcaaaccggaatggtcggactgacaccaattccttgttcttcgactccttcccgcttatctgaacgacacgcgtaacgcgtaagg

SEQ ID NO: 402607 - DNA, 664 bp, Homo sapiens
  misc_feature: GZ8MTXP01B42W6.8.37.D04.1.454.CMB.2.raw
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggacaaaacctggccaggcctccccgactcctcttcttggtggagcctacagggccactggccaccccagacaggatcagtggcaggcgggtctgggacagacttcattctccaccatcaacagaactgcagcctgaagatattgctagtttacactgtcagctaagtatcgttacgtccccgtaggtaccgttcgggaccgaaacggggggtaccaaaggggttcgggacctaaacgttacccgaaacccggtaaacgttcgggtacggccgttacgggacccaacccgtaattccgttacggtttccctttaccgtaaacgtttccccttttcccccgggaccccttaacgtttcccgtacgggtaaccgtaacccggaccgggaccgggttaaccgccggttaacggggg

SEQ ID NO: 402608 - DNA, 648 bp, Homo sapiens
  misc_feature: GZ8MTXP01DT89R.8.37.D04.1.454.CMB.2.raw
  modified_base (290)..(290): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaactgcaggcctcccgactcctcttcttggngagcctacagggccactggccaccccagacaggatcagtggcaggcgggtctggggacagtacttcattctccacctatccaacagaactgcagccctagaagtatattgacttagtttactacgtgtacagtactaagttattcggtttacccgtccccggttaggtacccggtttaccgggacccggtaaaggggggtaaccctaagggggttcggaacctaaacgttacccgaaaccgtaaccgttagggtcggccttacggcctaaacctgtccttcggttacccttcgaactttccccttaccccggcttaccgttcgacgaacgaccgaccggttagaacggcgtaacgggg

SEQ ID NO: 402609 - DNA, 624 bp, Homo sapiens
  misc_feature: GZ8MTXP01EE6XD.8.37.D04.1.454.CMB.2.raw
  modified_base (590)..(590): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcaggccagtgtaaccttttagtagttagttatttagcctggtatcggacaaaactggccaggcctccccgactcctcttcgttggtggagcctacgacgggccacgtcggccaccccagacaggatcgagtggcaggcgggtcgtgggacagtacttcattctcccaccatacaaacacgaactgcagcctagaaagtatatgactagttttacacgtgtcagtctaagttatcggttacccgtccccggtagggtaccgttcgggaaccctaaacggggggactaaaggggtcgacaaacgtaccgaaacccgtaatcggtggcctcggaccacccgtaatccttcgtctttcgaacttcccgttacccgcttattccgngtaacgaccgtacggacgtaacggcgtaacgggg

SEQ ID NO: 402610 - DNA, 673 bp, Homo sapiens
  misc_feature: GZ8MTXP01B2YSN.8.37.D04.1.454.CMB.2.raw
  modified_base (377)..(377): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaacctggccaggctccccgactcctcttcttggtggagcctacgagggccactggccaccccagacaggatcgagtggcaggcgggtctgggacagacttcattctccaccatcaacngaactgcagccctgaagatattgctagttttactactgtacagctaagttagtcgttaacccggtccccggttgggtaccggttaccgggacccgaaacggggggaccctaaggggtcgggactaaacgtacccgaaacccggtaacgttcggtcggaccttcgggaccctaaccctaacggttcccttgggttccctttaccgtaaccttccccttttacccccggcccttactttaaccgttacgggtaaccgtaacccggaccggttacggaaccggttcccgttaacggggg

SEQ ID NO: 402611 - DNA, 600 bp, Homo sapiens
  misc_feature: GZ8MTXP01A2Z08.8.37.D04.1.454.CMB.2.raw
  modified_base (194)..(194): a, c, t, g, unknown or other
  modified_base (269)..(269): a, c, t, g, unknown or other
  modified_base (273)..(273): a, c, t, g, unknown or other
  modified_base (275)..(275): a, c, t, g, unknown or other
  modified_base (278)..(278): a, c, t, g, unknown or other
  modified_base (280)..(280): a, c, t, g, unknown or other
  modified_base (283)..(283): a, c, t, g, unknown or other
  modified_base (288)..(288): a, c, t, g, unknown or other
  modified_base (294)..(294): a, c, t, g, unknown or other
  modified_base (297)..(297): a, c, t, g, unknown or other
  modified_base (300)..(301): a, c, t, g, unknown or other
  modified_base (304)..(304): a, c, t, g, unknown or other
  modified_base (306)..(306): a, c, t, g, unknown or other
  modified_base (314)..(314): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtcgtaactttagtagtagttattagctgtatcgacaaactgcagctccgntctntntgngnctnggcangcaccnacngannagngnaggcggtntgggacagtactcacttctaccaccatacaacagaactgcagcctaagaatatattgacttacgtttacacttgacagtagtacgtttagttcggttacccggtcccggtaggttacccggttaccggaaccgggtaaacgggggaacgtaaggggtaccgacgtaaacgtaaccgaaaccggtagtcggtacggacctgaccctaacgtcttcgttctcttaccgtcttccccgttcccttcgttattcccgagaaccgcacccgggagtaacggccgtaagggg

SEQ ID NO: 402612 - DNA, 566 bp, Homo sapiens
  misc_feature: GZ8MTXP01AO3WH.8.37.D04.1.454.CMB.2.raw
  modified_base (368)..(368): a, c, t, g, unknown or other
  modified_base (395)..(395): a, c, t, g, unknown or other
  modified_base (417)..(417): a, c, t, g, unknown or other
  modified_base (538)..(538): a, c, t, g, unknown or other
  modified_base (553)..(553): a, c, t, g, unknown or other
tcagctcgcgtgtccacgaccggtgctcgatttagtagcatactgttggggtttggggtcagttaggacccagagggaaccatggaaagcccagcgcagcttctcttcctcctgctactctggctcccagagacgaccggagagattgtattgacgcagtctccaaccaccctgtctttgtctccgtgggggagagccaccctctcctgcaggccagtgtaaccttttagtagtagttatttagctggtatcgacaaaacctgaccaggcctcccgactcctcttcgttaggtggacgcctacgagggccacgtcggccaccccagacaggatcgagtggcgaggcggtctgggacagacttcattcnccacatacaacagactgcagctagaanatatgctagtttacatgtacancagtattcgtacgtcccgaggtaccgtacggacgaacgggggtacaaggggtcgaactaactccgaaaccgtattcggacggctagccaccgtaatcgttctcttcgagttccttccccgnttactcagctaaccnggctaagcgtggg

SEQ ID NO: 402613 - DNA, 659 bp, Homo sapiens
  misc_feature: GZ8MTXP01AJEPN.8.37.D04.1.454.CMB.2.raw
  modified_base (643)..(643): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacacagtctccaaccaccctgtctttgtctccgtggggggagacgcccaccctctcctgcaggccagtagtaaccttttagtagtagttattacgctggtatacggacaaaaccgtgccaggcctccccgactcctcttcgttggtgacgcctagcgggtccacgtcggaccacccagacgaggatcgaggtcggacgaggtcgggtcgtagggacacggtacttcacttcctcccaaccatacaaacacgtaactcgcagtacctagaacgtattagtcgtacgtaatttacgtacttgtaccagtaccgtagttaacgttcgttaaaccccgtcccgaggttacgggttaccgttaccgggacggtaaacggggaccgtagggtacggacctaaagtaccaaaccggtacgtcgtgggtctacgacctaacgtacttctacgttccgttacctaccttcccttccccgttaccaattccgcgggaaccnccgacgtcggcgtcgg

SEQ ID NO: 402614 - DNA, 688 bp, Homo sapiens
  misc_feature: GZ8MTXP01AOHXP.8.37.D04.1.454.CMB.2.raw
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtgggggagagcccaccctctcctgcaggccagtgtaaccttttagtagttagttatttagcctggtatcggacaaaaccgtggaccaggcctccccgactccttcttcgttggtggacgcctacgacgggccacgtcggccaccccagacaggactcgagtgcaggcgggtctggggacagacttcacttctaccaccatacaaacagaaactcgcgacgccgtagaacgtattagttagaccttaagttttaacactaggtacaaggtcctaaaggttacgtttcggtttaacccgtccccgggttagggtacccggttcgggaacccgaaacggggggtacctaaaggggtccgaaccttaacgtaccgaaacccgtaacgttgggtcggccgtagaccctaaccgtcgtccttcggttacctttccgaacctttcccggttcccccgattactttaacccggtaggaaccgtaccgaccgggacgtaacggccgtaaggg

SEQ ID NO: 402615 - DNA, 611 bp, Homo sapiens
  misc_feature: GZ8MTXP01BR5HP.8.37.D04.1.454.CMB.2.raw
  modified_base (296)..(296): a, c, t, g, unknown or other
  modified_base (377)..(377): a, c, t, g, unknown or other
  modified_base (543)..(543): a, c, t, g, unknown or other
  modified_base (589)..(589): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtggggggagagcccaccctctcctgcgaggccagtgtaaccttttagtagtagttatttagcctggtatcgacaaaacctggccaggcctccccgactcctcttcgttggngagcctacgacgggccacgtcggaccacccccgagaccaggatcgagtggcaggtcgggtctggggacagtacttcattcnccaccatacaacagaactgcacgcctagaaagtatattgacttagtttacacttgcagctagttattcggttaccgtcccggtaggtacgttcggaaccgaagggggactaaggggtcgacgtaaactacccgaaaccggtaagtggtcgtctaggaccctaacgnttcgttgttccttctaccttcccgttcccgcttacttcgagtaacnccgacgcgtaacgttcgtcggg

SEQ ID NO: 402616 - DNA, 735 bp, Homo sapiens
  misc_feature: GZ8MTXP01EFOOU.8.37.D04.1.454.CMB.2.raw
  modified_base (303)..(303): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtgggggagacgcccaccctctcctgcgacgggccagtagtaaccttttagtagttagttatttagcctggtatcgacaaaacctggccaggcctcccgactcctcttcgttggtggancctacgacgggtccacgtcggccaaccccgagacgaggactcgaggtaggacgacgggtcgggggtacgtgggggaacaggtaacctttcacttcctaccacctataccgaaacacgaacctgaaccgcgtacctaggaaacgtattagttcgtaaccttaggtttacctacgttggtacaggtactaaggttacgtttacggttacccgggttacccgagggttaccgggttaaccgggacccgggtaaacggggggtaaaccccggtaagggggttacgaaccccgtaaacggttaacccgaaacccggtaaacggttcgggtacgggcccgttaacgcctaaccgtaatttcccgcgtttaccttacgacctttccccggttcccgaccttagttccgagaacgtaccgacgacgtcgaacccggtggg

SEQ ID NO: 402617 - DNA, 634 bp, Homo sapiens
  misc_feature: GZ8MTXP02IX1OE.8.37.D04.1.454.CMB.2.raw
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagctggtatcggacaaaactggccaggcctcccgactcctcttcttggtggagcctacgagggccacgtcggaccaccccagaccaggatcagtggcaggcgggtctgggacagacttcattctccaccatcaaacagactgcagctagaaagatatgatagtttactatgtacagtcagttactacgttacccggtccccgtagggtaccgttaccggacccgtaaagggggaaccctaagggtacggacgaaacgtaccgaaaccggtaaacgttggtacgggcttacgccaaccgtacttcgttcgttacctttacctaacgtttcccttaccccggacctacgttaaccgtacggaaacgaccgacggtaccggaacgtccgtacggg

SEQ ID NO: 402618 - DNA, 572 bp, Homo sapiens
  misc_feature: GZ8MTXP02JKVCG.8.37.D04.1.454.CMB.2.raw
  modified_base (364)..(364): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaacctggccaggctccccgactcctcttcttggtggagcctacagggccacgtggccaccccagacaggatcagtggcaggcgggtctggggacagacttcattcncaccatcaacagactgcagcctagaaagatatgctaagtttactactgacagcagttctcggttacccgtccccggtggtaccgttcggaccgaaaggggacccaagggtcggactaactaccgaaaccgtaacgtggtacggctagccaccgtatcgtgtctcactcccgttcccgctactcgtcgacgacacggcacggctacggg

SEQ ID NO: 402619 - DNA, 605 bp, Homo sapiens
  misc_feature: GZ8MTXP02H6GYG.8.37.D04.1.454.CMB.2.raw
  modified_base (193)..(193): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctccgtggggganagccaccctctcctgcaggccagtgaaccttttagtagtagttattagcctggtatcggacaaaactggccaggctccccgactcctcttcttggtggagcctacgacggccatcggcaccccgagaccaggatcaagtggcaggcggtctaggacagacttcattcaccacatcaacagactgcagctagaagatatgcaagtttacatgtacagcatatagttaacgtcccgtcgtacgttcggacgaacggaccgaaagtaggacggaactacgaaaccgaaaccgtaacgtggttacgtacgaccgaacaaacgtaccgtttacgttacttaccttaccttacccgttacccgtaccgtaccgtaacgtacgtaacgtaaccgtaaccgaccggtacgtacggtacgg

SEQ ID NO: 402620 - DNA, 540 bp, Homo sapiens
  misc_feature: GZ8MTXP02G5Q4L.8.37.D04.1.454.CMB.2.raw
  modified_base (362)..(362): a, c, t, g, unknown or other
  modified_base (417)..(417): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttattagcctggtatcggacaaaacctggccaggcctccccgactcctcttcttggtggagcctacgagggccactggcaccccagacaggatcagtggcaggcgggtctgggacagacttcattcnccacatcaacagactgcagcctagaagatattgactagtttacactgcagcagtntcgttacgtcccgtgacgttcggacaagggaccaggtgacaatcgaaacgactggtcggactgacacctagtcctgtccttcacttccttcccgcctatccgtagacgacacgcgacgctagg

SEQ ID NO: 402621 - DNA, 538 bp, Homo sapiens
  misc_feature: GZ8MTXP02FXQSM.8.37.D04.1.454.CMB.2.raw
  modified_base (362)..(362): a, c, t, g, unknown or other
  modified_base (390)..(390): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaacctggccaggcctccccgactcctcttcttggtggagcctacagggccactggcaccccagacaggatcagtggcaggcggtctggggacagacttcattcnccaccatcaacagactgcagcctagaanttattgactagtttactactgtcagcagtactgttacgtcccgtgacgttcggcaagggaccaaggtggacaagtcaaaccgactggtgctgcacgatctcgtctcacttccttcccgctactcgtagacgaccacggcgacgcgtgg

SEQ ID NO: 402622 - DNA, 560 bp, Homo sapiens
  misc_feature: GZ8MTXP02FWRBL.8.37.D04.1.454.CMB.2.raw
  modified_base (414)..(414): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaacctggccaggctcccgactcctcttcttggtggagcctacagggccactggcaccccagacaggatcagtggcagcgggtctgggacagacttcattctccaccatcaacagactgcagcctgaagatattgctagtttacactgtcagctagtntgttaccgtccccgtggacgttcggccgtaaagggaccctaaaggtcgggacaaagtaccgaaaccgtaactggtacgctagcaccatctgtcttacacttccttacccgctaactcgttcgaacgaccacgcgaacgcctacggg

SEQ ID NO: 402623 - DNA, 606 bp, Homo sapiens
  misc_feature: GZ8MTXP02FKJBI.8.37.D04.1.454.CMB.2.raw
  modified_base (370)..(370): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtcttgtctcctggggggagagccaccctctcctgcagggccagtgaaccttttagtagtagttatttagcctggtatcggcaaaacctggccaggctccccgactcctcttcttggtggagcctacaggccactggcaccccagacaggatcagtggcagcgggtctgggacagacttcattctccaccatcaaacngactgcagcctgaagatatgctagtttactatgtcagcagctagttacgtcccgtcgtaggttaccggtccgaacgggaaccggaacggtagggtacgaactaaccgtaaaccgaaacccgtagttacggcgtcgtacgaaccctaactcgttacggtccgtttcctaacttccgtttccccggtaccccacgttaaccttcgtaacgaaccgaccgaccggtacggaccgtcggg

SEQ ID NO: 402624 - DNA, 553 bp, Homo sapiens
  misc_feature: GZ8MTXP02JZYST.8.37.D04.1.454.CMB.2.raw
  modified_base (344)..(344): a, c, t, g, unknown or other
  modified_base (357)..(357): a, c, t, g, unknown or other
  modified_base (362)..(362): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggcaaaacctggccaggctccccgactcctcttcttggtggagcctacagggccactcggccacccccagacaggatcagtggcaggcgggtntgggacagacttnattcnccaccatcaaacagactgcagcctagaagatatgacagtttacactgacagctagtactgttaccgcccgtagacgttcggacaagggaccaaggtggacaacgtcaaaccgaactggtaggcctagccactacgtcctgtaccttcacttccttccccgctagtccgtagacacgacgcgacggtctagg

SEQ ID NO: 402625 - DNA, 575 bp, Homo sapiens
  misc_feature: GZ8MTXP02IWCRY.8.37.D04.1.454.CMB.2.raw
  modified_base (286)..(286): a, c, t, g, unknown or other
  modified_base (289)..(289): a, c, t, g, unknown or other
  modified_base (293)..(293): a, c, t, g, unknown or other
  modified_base (323)..(323): a, c, t, g, unknown or other
  modified_base (351)..(351): a, c, t, g, unknown or other
  modified_base (374)..(374): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggcaaaaacctggcaggctcccgactctctcttgnganctanaggcactggcaccccagacagatcagtggnagcgggtctgggactagacttcatttcnccaccatcaaacacgactgcacnctagaagtatatgactaagtttactactgtacagatagtatcgttaccgtcccggtagaccgttcggaccggaaacggaaccgaggtacgaccgaaactaaccgaaaccgtaaacgtggtacgtcgtcgcgactaactactctcttacctactaccttccctcctacctaacgtacgtacgacgaccgtacgacgacgtag

SEQ ID NO: 402626 - DNA, 682 bp, Homo sapiens
  misc_feature: GZ8MTXP02GK4II.8.37.D04.1.454.CMB.2.raw
  modified_base (193)..(193): a, c, t, g, unknown or other
  modified_base (282)..(282): a, c, t, g, unknown or other
  modified_base (290)..(290): a, c, t, g, unknown or other
  modified_base (293)..(293): a, c, t, g, unknown or other
  modified_base (296)..(296): a, c, t, g, unknown or other
  modified_base (303)..(303): a, c, t, g, unknown or other
  modified_base (323)..(323): a, c, t, g, unknown or other
  modified_base (355)..(355): a, c, t, g, unknown or other
tcagctcgcgtgtccacgaccggtgctcgatttagtagcatactgttgggtttggggtcagttaggacccagagggaaccatggaaagcccagcgcagcttctcttcctcctgctactctggctcccagagacgaccggagagattgtattgacgcagtctccaaccacctgttctttgtctccgtggggganacgccaccctctcctgcgagggccagtgaaccttttagtagttagttattagcctggtatggacaaaacgtgccagcctcccgatcctnttcttggngancanaggccancggcaccccagacaggatcnggtagcgaggcgggtgtgggacagtacgttanacgtttaccacccctacctaataccgaaacaggacttagccgtagactaagggaaatagtacgttgtacttaacgtttactaaccgtgtcgaaatccgtaagttacgttcggttaacccgtccgggtacgtaccggttaccggaccggaaagggtaccgtaagggttccggaactaacgtaaacccggtaaaacgggtacttcggtaacggggttccaaccggggtacctaacgtacgtttctaccggttctttaccttaccgttcccgtaccctaccttaccggttaacgtacggaacgaccgtaacggaccgtacggacgtgggg

SEQ ID NO: 402627 - DNA, 489 bp, Homo sapiens
  misc_feature: GZ8MTXP01EF8S8.10.74.G08.1.454.CMB.2.raw
  modified_base (206)..(206): a, c, t, g, unknown or other
  modified_base (414)..(414): a, c, t, g, unknown or other
  modified_base (420)..(420): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctntcctgcagggccagtcagagtatagcagcaacttagcctggtaccagcaagaaacctggccagtctcccaggctcctctcatgatgcatccacaggccatggtatcccagccaggttccagtgcagtggtctgggcagagttcactctcacatcagcagctgcagtctgagatagtgactagtttatactgtcagcagtatactaacngtcctntgcgttcggaccaaggggaccaggggtagaaattcgaaaacgactggtcggaactggcacctgttcttg

SEQ ID NO: 402628 - DNA, 486 bp, Homo sapiens
  misc_feature: GZ8MTXP01DR5FX.10.74.G08.1.454.CMB.2.raw
tcagcatagtagtgcacgaccggtgctcgatttagtagctctatcaggggaggaactgctcagttaggacccagacggaaccatggaagcccagcgcagcttctcttcctcctactactctggctcccagataccactggagaaatagtgatgacgcagtctccagccaccctgtctgtgtctccaggggaatgagccacctctcctgcagggccagtcagagtattagcagcaacttagcctggtaccagcagaaacctggccagtctcccaggctcctcctctatgatgcatccaccaggcccatggtatcccagccaggttccagtggcagtgggtctgggcagagttcactctcacatcagcagcctgcagtctgaggatatgctagtttattactgtcagcagtatactaactggtcctctgcgttcggcaaagggccagggtggaaattcgaaacggaactgtaggctgcacctgttctg

SEQ ID NO: 402629 - DNA, 613 bp, Homo sapiens
  misc_feature: GZ8MTXP01AU0CZ.10.74.G08.1.454.CMB.2.raw
  modified_base (264)..(264): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagacgccaccctctcctgcagggccagtcagagtattagcagcaacttgcctggtaccagcaagaaaccnggccagtcctcccaggcctcctctctatgatgctactcccaccgagggcccagtggtactcccgagcctagggttcccaggtggctagggtcgggtctaggggaacaggtacgtttccaccttctaccaacctatccgagtccacggtcctgacgtagtctaggtaggtattagttgacttaggtttacttacgtgtacaagtctaagttactaacgtaaccgtggtcccttacgtggtacccggttcgggaaccgaacgggggtaccgttaagggggtaacgtaaaacgttaccgaaaacggttaccgttgggtcggtccttcggaccttaccgtaattccgttaacg

SEQ ID NO: 402630 - DNA, 495 bp, Homo sapiens
  misc_feature: GZ8MTXP01DVNUR.10.74.G08.1.454.CMB.2.raw
  modified_base (431)..(431): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccacctctcctgcagggccagtcagagtattagcagcaacttgcctggtaccagcaagaaacctggccagtctcccaggctcctctctatgatgcatccacagggccatggtactcccagccaggttccaggtggctaggtgggtctgggcagtacgttcactctcaccatcagcagcctgcagtctgagatatgactagtttatactgtcagcagtatactaactggtcctntcgcggttcggcgaaggggacaaggggtacgaaattacgaaacgactgtagctgcactgttctg

SEQ ID NO: 402631 - DNA, 508 bp, Homo sapiens
  misc_feature: GZ8MTXP01CKCID.10.74.G08.1.454.CMB.2.raw
  modified_base (262)..(262): a, c, t, g, unknown or other
  modified_base (485)..(485): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctctcctgcagggccagtcagagtatagcagcaacttagcctggtaccagcagaaaccnggccagtcctcccaggcctcctctctatgatgcatccaccgagggcccactggtactcccagccaggttcccaggtgcaggtggggtactggggcaggtagttcactctcacatcagcagcctgcagtctgaggatatgctagtttatctgtcagctagtatactaactggtcctgtgacgttcggacgaagggccgagggtacggaattacgaaacgagtgnggctgacttaccgtaagttcttg

SEQ ID NO: 402632 - DNA, 604 bp, Homo sapiens
  misc_feature: GZ8MTXP01D1BT4.10.74.G08.1.454.CMB.2.raw
  modified_base (445)..(445): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccatggagaaatagtgatgacgcagtctccagccaccctgtctgtgtctccgagggggaagagccaccctctcctgcagggccagtcagagtatagcagctaacttagcctaggtaccagcaagaaacctggccagtcctaccaggcctcctcctctatgatgccatcccgaccgagggccctaacgtggtactcccgagcccgtaggtttcccaggtggcgtaggttgggtactaggggaactaggtacgttccaactccgtacaactatcaacgcacgtcctgaccgagttcgtagaggtattacgtntacgttagtttattacttgtacctagactacgtataacgtaacgtcggtccttcgtcggtaccgttcgggaacgaaacggggtaccaaagggggtaaccgaaaagttacgaaaacgttacggtgggttcgcgtcggaccttaccgtaattcggttaacg

SEQ ID NO: 402633 - DNA, 556 bp, Homo sapiens
  misc_feature: GZ8MTXP01AFVCJ.10.74.G08.1.454.CMB.2.raw
  modified_base (262)..(262): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctctcctgcagggccagtcagagtatagcagcaacttagcctggtaccagcagaaaccnggccagtcctcccaggcctcctcctctatgatgcatcccaccgagggccacgtggtactcccagcccgaggttccaggtggcaggtgggtctgggaacagagttcactctcacatcagcagcctgcagtctgagattatgactagtttattactgtcagtactagtatactacgtcggtcctcgtggaccggttcgggaccgttaaagggggaccgagggggtaacgtaaaacgttacgaaaaccggttacgttgggacgggtccttacggacccgttacgtaacttcgtttcg

SEQ ID NO: 402634 - DNA, 563 bp, Homo sapiens
  misc_feature: GZ8MTXP01DARMU.10.74.G08.1.454.CMB.2.raw
  modified_base (386)..(386): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggagacgccacctctctgcagggccagtcagagtatagcagctaacttagcctggtaccagcaagaacctggccagtcctcccaggtcctcctctctatgatgcactccaccgagggcccagtcggtactcccgagccagggttcccaggtggcgtaggtcgggtactaggggaacaggtacgttcactcctcacntcagcagcctgaccagtctgagtatatgactagtttatactgtacagtctaagttataccgtaacgtcggtaccttcgtacggtacggtaaccggaccggaaagggtaccggagggtaaacggtaaattaccgaaacggttacgtggacggtctacggccaaccgtcttcgttaacg

SEQ ID NO: 402635 - DNA, 684 bp, Homo sapiens
  misc_feature: GZ8MTXP01B79DX.10.74.G08.1.454.CMB.2.raw
  modified_base (201)..(201): a, c, t, g, unknown or other
  modified_base (210)..(210): a, c, t, g, unknown or other
  modified_base (272)..(272): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctccagataccatggaagaaatagtgatgacgcagtctccagcccacctgtctgtgtctaccggaaggggaagacncccaccctntcctgcgagggccagtcaagtagtatagcagacaacttgcctggtaccagacaagaaaccgnggaccagtcctcccgaggtcctcctctctaatgactgaccactacccgaccgacgggcccacgttcggtacctccccgaagtcccgtaaggtttccccgagggtgggcgtaaggggtcggggtaaccgtaggggaactagggtacgtttcaacctctaccaactacgtccaagccaggccctggactaggtctaggaaggtattacgttcgtagtttaagttttacgtacgttcggttaccaaggtaccttaaaggttaactaaaccgtttaaccgtcgggtcccttacggtcggtaaccgggtttaaccgggaaccggttaaagggggacccgttaaagggggtaaacgtaaaacttacccggaaaagttaccggttggtaccgaagtcgaccttaacctgttaacgttcg

SEQ ID NO: 402636 - DNA, 613 bp, Homo sapiens
  misc_feature: GZ8MTXP01ANZ7K.10.74.G08.1.454.CMB.2.raw
  modified_base (198)..(198): a, c, t, g, unknown or other
  modified_base (250)..(250): a, c, t, g, unknown or other
  modified_base (258)..(258): a, c, t, g, unknown or other
  modified_base (266)..(266): a, c, t, g, unknown or other
  modified_base (298)..(298): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggcctcccagataccactggagaaatagtgatgacgcagtctccagccacctgtctgtgtctccgaggggaagcnccaccctctctgcgacgggccagtcagtagtatagcagcaattgcctggacngcagaacngcagtccnccagctcctctctatgatgctactcccaccgnggacccacgtcggtaccacccgagccgtagggttccagggtcggacgtaggggttcggtacgtaggggaactaggtacgttaccactcctacaaccgtatccgagtccagccgtagcgtacgtcgtagaggtattagttcgtatttagtttattacgtgtacgaagtacctaagtacttaaccgtacgtcggtccttacgtacgggtaccggtcggaaccgggttaaacgggtacgttaagggtaaacgtaaacgttaaccgaaacggttacgtggtcggtaacctacggaccttacctaagtttccgttaaccg

SEQ ID NO: 402637 - DNA, 678 bp, Homo sapiens
  misc_feature: GZ8MTXP01AKZND.10.74.G08.1.454.CMB.2.raw
  modified_base (194)..(194): a, c, t, g, unknown or other
  modified_base (203)..(203): a, c, t, g, unknown or other
  modified_base (207)..(207): a, c, t, g, unknown or other
  modified_base (303)..(303): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagccacctgtctgtgtctcgagggagngccaccctntccngcagggccagtcagagtattagcagcaacttgcctggtaccagcaagaaacctggacagtcctcccagtcctcctctctatgatgcactccaccgngggccacgtcggtactcccgaggccgaggttccaggtgggctagggtcggggtacgtggggaacagggtacgttccactccgtacacctatccgacgcgacgtccgtacgcgtacgtcgtaggaacggtattacgttacgtaactttaacgtttttaacgttacgttacggttacaacggtaagttaacgttaactttaaccgttaaccggtcgggttccccttacggtttaccgggtaaccgggtttaaccccggggaacggttaaaccgggggtaacggttaaacgggggttaaacggtaaaacgttaccggaaaaaccgggttcgtaacgggttaggccgttacggacccttactaacgttcccgttaacgg

SEQ ID NO: 402638 - DNA, 514 bp, Homo sapiens
  misc_feature: GZ8MTXP02GE9J6.10.74.G08.1.454.CMB.2.raw
  modified_base (441)..(441): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaggagccaccctctcctgcagggccagtcagagtattagcagcaacttagcctggtaccagcagaaacctggccagtcctcccaggcctcctcctctatgatgcatcccaccgacgggcccactggtactcccagccaggttccagtggcaggtgggtctggggacagtagttcactctacaccatcagcagcctgcagtctagagatatgactagtttatactgtcagcagtatactaactgcctntgacgttcggaccgaagggaccaggggtacgaaactacgaaacgtaacgtgtaggctacgcaccagttctacg

SEQ ID NO: 402639 - DNA, 522 bp, Homo sapiens
  misc_feature: GZ8MTXP02GBMGE.10.74.G08.1.454.CMB.2.raw
  modified_base (360)..(360): a, c, t, g, unknown or other
  modified_base (378)..(378): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaggagccaccctctcctgcagggccagtcagagtattagcagcaacttagcctggtaccagcagaaacctggccagtcctcccaggcctccctcctctatgatgcatcccaccagggcccacgtggtactcccagccaggttcccagtgcaggtggtctggggacngtacgttcactctcaccntcagcagtcctgcagtctgagtatatgactagtttatactgtcagtcagtatacactgctgtgacgtcggactaagggacctaggggtacgaaactacgaaaacgtacgtgtacggaccttaggacctaccgtagtcctttacg

SEQ ID NO: 402640 - DNA, 502 bp, Homo sapiens
  misc_feature: GZ8MTXP02GPKCL.10.74.G08.1.454.CMB.2.raw
  modified_base (288)..(288): a, c, t, g, unknown or other
  modified_base (354)..(354): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaggagccaccctctcctgcagggccagtcagagtattagcagcaacttagcctggtaccagcagaaacctggccagtctcccaggctcctcctntatgatgcatccaccagggcccatggtatcccagccaggttccagtgcaggtggggtctggggacngagttcactctcaccatcagcagcctgcagtctgagatatgctagtttatctgtcagctaagtatactaatcggctcgtgacgttcggaccgaagggaccaggggtacgaaactacgaaaacgtatgtggcctagcctacacgtctcg

SEQ ID NO: 402641 - DNA, 576 bp, Homo sapiens
  misc_feature: GZ8MTXP02JR6F9.10.74.G08.1.454.CMB.2.raw
  modified_base (271)..(271): a, c, t, g, unknown or other
  modified_base (285)..(285): a, c, t, g, unknown or other
  modified_base (358)..(358): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaagagccaccctctcctgcagggccagtcagagtattagcagcaacttgcctggtaccagcagaacctggccagtcnccagcctcctcctntatgatgcatcccacgagggccacgtggtactccccgagccaggttcccagtggcaggtgggtctggggcagngttcactctacaccatcagcacgcctgcgtagtcgtggaggtatagttgtacgttagtttattacgttgtacgtagtactagtacttaacgttaacgtcggtcgttacccccgtagtaccggttaccggtaccggaacgggtaccggtaacgggtacggtaaacgtaacgtaaacgtaacgtaacggtacggtacgtacgacaccgtacgtcgttacg

SEQ ID NO: 402642 - DNA, 498 bp, Homo sapiens
  misc_feature: GZ8MTXP02IRE8L.10.74.G08.1.454.CMB.2.raw
  modified_base (287)..(287): a, c, t, g, unknown or other
  modified_base (290)..(290): a, c, t, g, unknown or other
  modified_base (302)..(302): a, c, t, g, unknown or other
  modified_base (314)..(314): a, c, t, g, unknown or other
  modified_base (345)..(345): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaacctggccagtcctcccaggctcctcctntangatgcatccacnggcccatgtacnccagccaggttccagtgcaggtggctgggcngagttcactctcacatcagcagcctgcagtctgagatattgctagtttatactgtcagctagtactactaatcggccttgtgaccgttcggaccaaaaggggccaagggggtagaaaactacgaaaacgattggaggctacgcaacctatctg

SEQ ID NO: 402643 - DNA, 562 bp, Homo sapiens
  misc_feature: GZ8MTXP02IO1PY.10.74.G08.1.454.CMB.2.raw
  modified_base (303)..(303): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaagagccacctctcctgcagggccagtcagagtattagcagcaacttagccctggtaccagcagaacctggccagtctcccaggctcctcctctatgatgcatccacgnggcccacgtggtactcccgagccaggttccaggtggcaggttggtctggggactagacgttcactctcacctatcagcagcctgcagtctgagtatatgactagtttatacgtgtcagtactagttactacttaacgtcggcctttagacgtaccggtttcgggacccgttaaaacgggggccgtaaagggggtacgtaaaacgtaaccgaaaacgtaaaccgtggtacggacttacggaccgtacctattaccgttcg

SEQ ID NO: 402644 - DNA, 569 bp, Homo sapiens
  misc_feature: GZ8MTXP02GA86N.10.74.G08.1.454.CMB.2.raw
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctctcctgcagggccagtcagagtattagcagcaacttagcctggtaccagcagaacctggccagtctccaggcctcctctctatgatgcatccaccgagggcccacgtggtactccccgagccgtaggttcccaggtcggcaggtcggggtctggggacaggtacgttccacgtcctacacctatcgaagcagcctgctagtcgtagaggtattacgttgacttaagtttattacgtgtacagactaagtataactaacgtcggcctgtcgaccgttcggaccctaaagggggcccgtaaaggggtacggaaaactacgaaaaccgtaagtcggtacggactcggacctaaccgtatcctttacg

SEQ ID NO: 402645 - DNA, 590 bp, Homo sapiens
  misc_feature: GZ8MTXP02IVX1X.10.74.G08.1.454.CMB.2.raw
  modified_base (394)..(394): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaagagccaccctctcctgcagggccagtcagagtattagcagcaacttagcctggtaccagcaagaaacctggccagtcctcccaggcctcctcctctatgatgcactccacgagggcccagtggtactcccagccaggttccagtgcaggtgggtctggggcagtacgttcactctacaccatcagcagcctgcagtcngaggtatagtgacttagtttatactgtcagctaagttataactaacgtcggtaccttacgtacgtaccggtttaccgggaacccggtaaaacgggggtaacccgtaaagggggttaacggtaaaaacgttaaccggaaaaacggttaacgttggtacgggtaccttacggaacctacccggtaatttccgtttacg

SEQ ID NO: 402646 - DNA, 644 bp, Homo sapiens
  misc_feature: GZ8MTXP02I7BUE.10.74.G08.1.454.CMB.2.raw
  modified_base (634)..(634): a, c, t, g, unknown or other
tcagcatagtagtgcacgaccggtgctcgatttagtagctctatcagggggaggaactgctcagttaggacccagacggaaccatggaagccccagcgcagcttctcttcctcctactactctggctcccagataccactggagaaatagtgatgacgcagtctccagccaccctgtctgtgtctccaggggaatgagccaccctctcctgcagggccagtcagagtattagcagcaacttagcctggtacccagacaagaaacctggccagtcctcccaggcctcctcctctatgatgccactcccaccgagggcccagtcggtactcccagccctaggttcccagtcggctagggtgggtccgtggggactagggtacgtttccaccttcctaccgaaccctagttacccgaggtaccaacgggtccttggaccgtaaggtccgtaaggggacgggtaatttacgttcggtactttaacggtttttattaccgttgtacagggtactaagttaacttacgttaacgttcggtcccttacgtacggttaccggttaccgggacccggaaaggggtaccgaagggggtacgaaaactaccgaaaacgtagtcggtcgacgtcgacctaaccgtnttaccttacg

SEQ ID NO: 402647 - DNA, 515 bp, Homo sapiens
  misc_feature: GZ8MTXP02GWQ9P.10.74.G08.1.454.CMB.2.raw
  modified_base (273)..(273): a, c, t, g, unknown or other
  modified_base (287)..(287): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaggagcccaccctctcctgcagggccagtcagagtattagcagcaacttagcctggtaccagcagaacctggccagtcnccagcctcctcctntatgatgcatccacgaggcccactggtactccagccaggttccagtgcaggtggtctgggctagagttccactctacacatcagcagcctgctagtctagaggattagtgactagtttatctgtcagacagttatactaatcggtcctgtcgacgttacggaccgaagggtaccgaggggtacgaaaacgtcgaaaagtcgtaaggtcggactgaccactacgtctcg

SEQ ID NO: 402648 - DNA, 532 bp, Homo sapiens
  misc_feature: GZ8MTXP02HWEDS.10.74.G08.1.454.CMB.2.raw
  modified_base (356)..(356): a, c, t, g, unknown or other
  modified_base (371)..(371): a, c, t, g, unknown or other
  modified_base (387)..(387): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaggagccaccctctcctgcagggccagtcagagtattagcagcaacttagcctggaccagcagaacctggccagtctccaggctcctcctctatgatgcactccaccagggccacgtggtactcccagccaggttccagtggcaggtggtctggggacagngttcactctcactancagcagcctgcagtcngaggatatgactagtttattactgtacagtacagttatacttaacgtcggcctgtcgtacggttcggaccgtaaggggacccgtagggggttacgaaaacgtacgaaacgtaacgtggtacggctcggactaccgattacgttcg

SEQ ID NO: 402649 - DNA, 511 bp, Homo sapiens
  misc_feature: GZ8MTXP02HGXI6.10.74.G08.1.454.CMB.2.raw
  modified_base (430)..(430): a, c, t, g, unknown or other
  modified_base (447)..(447): a, c, t, g, unknown or other
  modified_base (501)..(501): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctccagataccactggagaaatagtgatgacgcagtctccagccaccctgtctgtgtctccgagggggaaggagccaccctctcctgcagggccagtcagagtatagcagcaacttagcctggtaccagcaagaaacctggaccagtcctcccaggcctcctcctctatgatgcatcccaacgagggcccacgtggactccagccgtaggttccagtggcaggtggctggggacaggtattccacgtctacacctatcagcacgcctagcctagtctaggaggtatagtgacttagtttatcgtntcagacagtacactacngctgagtcgtcgacgaaggacagggacgaactacaacgactggcgactcgaacnctagttctcg

SEQ ID NO: 402650 - DNA, 573 bp, Homo sapiens
  misc_feature: GZ8MTXP02GN71U.10.74.G08.1.454.CMB.2.raw
  modified_base (289)..(289): a, c, t, g, unknown or other
  modified_base (352)..(352): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaggagccaccctctcctgcagggccagtcagagtattagcagcaacttagcctaggtaccagcagaaacctggccagtctcccaggctcctcctntatgatgcatccacgaggcccatggtactccagcctaggttccagtgcaggtggctggggacngacgttcactctacaccatcagcagcctgctagtctagaggtatagtgactagtttatactgcagctaagtactacgtaactcggtacctcgtggaccggtttcggaccccgtaaaagggggaccctaagggggttaacggaaaacgttaaccgaaaaaccggttaaacgttggggtaacggtaccgttacggacccaacccgttaactttaccgtttcgg

SEQ ID NO: 402651 - DNA, 593 bp, Homo sapiens
  misc_feature: GZ8MTXP02HI106.10.74.G08.1.454.CMB.2.raw
tcagcatagtagtgcacgaccggtgctcgatttagtagctctatcagggggaggaactgctcagttaggacccagacggaaccatggaagccccagcgcagcttctcttcctcctactactctggctcccagataccactggagaaatagtgatgacgcagtctccagccaccctgtctgtgtctccgaggggaatgagccaccctctcctgcagggccagtcagagtattagcagcaacttagcctggtaccagcagaaacctggccagtcctcccaggcctcctcctctatgatgcactcccaaccgagggcccaactgggtactcccccaggcccgtaggttcccaggtcggactagggtcggggtctaggggactaggtacgtttccaaccttcgtaccaaccctatcaacgcacgcctgactagtctagaggtaatattgacttaagttttatacttggtacaggtactaagtactaacgtaacgtcggtccctgtacgtacggttacggaccgtaaaggggacccgtaggggtaacgtaaactacgaaaacgtacgtaaggtcggactacgacctaccattcgtacg

SEQ ID NO: 402652 - DNA, 564 bp, Homo sapiens
  misc_feature: GZ8MTXP02HS9SD.10.74.G08.1.454.CMB.2.raw
  modified_base (284)..(284): a, c, t, g, unknown or other
  modified_base (318)..(318): a, c, t, g, unknown or other
  modified_base (419)..(419): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggagacgccacctctcctgcagggccagtcagagtattagcagcaacttagcctggtaccagcaagaacctgccagtctccagcctcctcctntatgatgcactccaccgagggcctacgtggtacncccgagcctaaggttcccaggtcggcgtagggttgggtaccgtggggacctaggtacgttccaccttcaccaacatcaagcacgcctgctagtctggagtntattgacgttagtttacttatgactagtactagtactaacgtacgtcgtaccttgtacgtacgttccggaacgtaacgggactaacggggtagaaactacgaaaacggtacgtggtacggcttacggacctaaccgtctttcgtc

SEQ ID NO: 402653 - DNA, 522 bp, Homo sapiens
  misc_feature: GZ8MTXP02JP64R.10.74.G08.1.454.CMB.2.raw
  modified_base (355)..(355): a, c, t, g, unknown or other
  modified_base (361)..(361): a, c, t, g, unknown or other
  modified_base (377)..(377): a, c, t, g, unknown or other
  modified_base (380)..(380): a, c, t, g, unknown or other
  modified_base (433)..(433): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaagagccaccctctcctgcagggccagtcagagtattagcagcaacttgcctggtaccagcagaaacctggccagtctcccaggcctcctcctctatcgatcgcatcccaccagggcccacgtggtactccccagccctaggttcccagtggcaggtgggtcnggggcngagttcactctcaccntcngcagcctgcagtctgagatatgactagtttatctgtcagctagtatactaacnggcctctgtaccgttcggaccgtaaggggaccaggggttacgaaaactccgaaaacgtacgtggtacggctagaccaaccgtctcgtcg

SEQ ID NO: 402654 - DNA, 549 bp, Homo sapiens
  misc_feature: GZ8MTXP02I4Z7J.10.74.G08.1.454.CMB.2.raw
  modified_base (291)..(291): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaagcgccaccctctcctgcagggccagtcagagtattagcagcaacttagcctggtaccagcaagaacctggccagtcctcccgaggcctcctcctntatgatgcactccacgaggcccagtcggtactcccagcctaggttccaggtcggctaggtgggtctggggacagggtcttccacttcctacacctatcgagcacgcctgcagtctaggagtatatgtacttagtttatacgtgtacagtctaagtatacgtacgtcggcttgtcgtacgttacggacgtaagggaccgtaaggggtacaaacgtacgaaacgtagtcggtaggcctacgacctacgtctttacgtacg

SEQ ID NO: 402655 - DNA, 601 bp, Homo sapiens
  misc_feature: GZ8MTXP02F8FSO.10.74.G08.1.454.CMB.2.raw
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctctcctgcagggccagtcagagtattagcagcaacttgcctggtaccagcaagaaacctggaccagtcctcccaggcctcctcctctatgatgcactccaccgagggcccacgtggtactccgagcctaggttccagtggctaggtcgggtctgggacaggtacgttcacgtctacaccatcagcacgcctgctagtcgaggaaggtattagtcgtacttagtttattacgttgtacaagtctaaagttactaacttaacgtcggcccttacgtacggtaacccggttcgggaacccggtaaaagggggtacccggtaaagggggtaaacgtaaaaccgttaaaccggaaaacggtaacgtgggtacggacgtacgactaaccctagtttacgttcg

SEQ ID NO: 402656 - DNA, 602 bp, Homo sapiens
  misc_feature: GZ8MTXP02GXKB1.10.74.G08.1.454.CMB.2.raw
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagcgccaccctctcctgcagggccagtcagagtatagcagcaacttagcctaggaccagcaacgaacctgccagtcctccaggcctcctcctctatgactgcactccacgacggcccagtcggtacctcccgagccgtaggttccaggtcggctaggggttcggggtactggggacagggtacgtttccaaccttccgtaccaaccctagtccagccagtccctagcgtagtcgagtacggtattacgtgtaacttaagttttactacgttgtacgtaggtactaagttaactactaacgtcgtaccctagtcggtaaccggttcggaccggtaaagggaccgtaggggtaaacgtaaaccgttaacgaaacgtagtggtacgacgtacgactacgtacgttcttacg

SEQ ID NO: 402657 - DNA, 499 bp, Homo sapiens
  misc_feature: GZ8MTXP02FHDDJ.10.74.G08.1.454.CMB.2.raw
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccagggaagagccaccctctcctgcagggccagtcagagtattagcagcaacttagcctggtaccagcagaaacctggccagtctcccaggctcctcctctatgatgcatcccaccaggggcccactgggtatccccagccaggttccagtggcagtggggtctggggcagagttcactctcaccatcagcagcctgcagtctgaggatatttgcagtttattactgtcagcagtatactaactggcctctgacgttcggccaaggggaccaggggtaggaaaactcaaaacgaactgtgctgcaccactctcg

SEQ ID NO: 402658 - DNA, 630 bp, Homo sapiens
  misc_feature: GZ8MTXP02H9YOU.10.74.G08.1.454.CMB.2.raw
  modified_base (182)..(182): a, c, t, g, unknown or other
  modified_base (207)..(207): a, c, t, g, unknown or other
  modified_base (322)..(322): a, c, t, g, unknown or other
  modified_base (339)..(339): a, c, t, g, unknown or other
tcagcatagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtntctcgaggggaagcgccacctctcngcgaggccagtcagtagtatgcagctaacttagccttggaaccagacacgaaacctcggaccctacgtctccccgaggtcctcccgtcctactatgtactgccacgtccaccggnggcccagttcggtaccncccgagtccctaaggttccgacggttcggcgtaagggttcggggttcctaggggacctggtaccgtttcacctacctatacccgatacgagcctacgccctagcgttacgtctaggtagtaagttgtacttaacgttagtttaactcgttgtaccgatacgtactacttacgtacgtcgtccgtacgtacggtaccgtacggtaccgggtaaacggtaccggtaagggtaaactaacgtaaacgtaacgtaacgtggtacgtacgtaccgtacgaccttgttaccgtttcg

SEQ ID NO: 402659 - DNA, 611 bp, Homo sapiens
  misc_feature: GZ8MTXP01CB7VB.21.12.B01.1.454.CMB.2.raw
  modified_base (225)..(225): a, c, t, g, unknown or other
  modified_base (246)..(246): a, c, t, g, unknown or other
  modified_base (270)..(270): a, c, t, g, unknown or other
  modified_base (370)..(370): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgtttggtctttangactatgtctctggtaccaacaanaccaggcaaacgccccaaactcatcatttatgatgtacagtaatccggcctacgtagggggtttctaaatcgtcttctctcggctcaagtctggacaacncggcctcccgtcgacctatctctgggcctccgaggctgactggaacgagggctagtattacttaactgactaggggtacaataattaaccaaatcaagactaaactcttatacgttcgtttacgggaacgttacgggaaccctaaaggacttaccgaacccggttaccgttacggttaccgaacccggtaaccccgaaacgggaccccaaaccccggttacttaacggttcccgtaacccg

SEQ ID NO: 402660 - DNA, 607 bp, Homo sapiens
  misc_feature: GZ8MTXP01EP2R8.21.12.B01.1.454.CMB.2.raw
  modified_base (301)..(301): a, c, t, g, unknown or other
  modified_base (308)..(308): a, c, t, g, unknown or other
  modified_base (422)..(422): a, c, t, g, unknown or other
  modified_base (453)..(453): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctctgcactgaaccagcgtgacgttgtctttatgactatgtctcctggtaccaacaactacccaggacaaacgaccccaaactcatctatttangatgtanagtaagtcgcctcgaggggtttactaatcgtcttctcgtcgctacaagtctacggaccaacgccggtcctcccgtacgacctatctcgtcgggcctacgaggctagatgaacgngctagtattatactacgcgagggtcaattanaactactcaacactaaactcgtttaatcggttaccgttggggaaccttaacgggaacctaaacggttactaacccgtacccgttaccgttacgggttaaccaaccgaacccgaaccggaacccctaaccccacgtccgttaacccgttaacccg

SEQ ID NO: 402661 - DNA, 583 bp, Homo sapiens
  misc_feature: GZ8MTXP01A1VEK.21.12.B01.1.454.CMB.2.raw
tcagtcgtcgctcgcacgaccggtgctcgatttagtagtgtagattcgcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttatgactatgtctctgtaccaacaataccagacaaacgccccaaatcatcattatgatgtacagtactccggccctgtagggtttctaatcgtcttctcctggctcaagtctagacaaccgcgtccctccctcgacctactctcgtcgggcttccgaggtctagagtcggaacggtagtcctagtatttagtacgtgacggtagtactataactaacaatcaagtacctaactacgttatcggtcgttaacgggtaacgttacgggaacaaggtactccgttaccgttccgttacggtccaacggaacccgaacggccccttaaaccctcgttcgtaacccg

SEQ ID NO: 402662 - DNA, 712 bp, Homo sapiens
  misc_feature: GZ8MTXP01EUCV5.21.12.B01.1.454.CMB.2.raw
  modified_base (208)..(208): a, c, t, g, unknown or other
  modified_base (217)..(217): a, c, t, g, unknown or other
  modified_base (224)..(224): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacgagggtcctgggcccagtctgccctgactcagcctgcctccgtgtctggtctccgtggacagtcgatcaccntctctgcanggaaccnggcggtgacgttggtcttatgactatgtctcctaggtaaccaacaacacccaggaccaaaccgccccaaatcatactatttatagtatgtacgagtacgtccggtccctagtacgggtttactagttcgtcttctcgtcgctacgtaagtcgtacggaacaacgccggtccctcccgtcgacctagttcgtacgtcggtcctaccgtacggtcgtagtagtacggtacggacgtacgttagtattacgttacgtacgacgtacggggtactaactaactaactaactaaccgtaacgtaactaaacttaacgttacgttacggttaccgggttaaccggggtaaccggttaacgggttaaaccggtaaacgttaaccgttaacccggttcaaaacgggggtttccccttaaaagggggttccccccaaaaggggtccccctaaaaacccggggccccttaaaccccggttcccttaaccggtttcccc

SEQ ID NO: 402663 - DNA, 602 bp, Homo sapiens
  misc_feature: GZ8MTXP01DNZUW.21.12.B01.1.454.CMB.2.raw
  modified_base (244)..(244): a, c, t, g, unknown or other
  modified_base (470)..(470): a, c, t, g, unknown or other
  modified_base (486)..(486): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatgtctcctggtaccaacaatacccaggacaaacgaccccaaactcaatcaatttatgatgtacagtaatccggtaccctgtaggggtttactaattccgtcttctcgttcggctaccaagtctggaaccaacgtccggccctacccgtgaacccctatcgtcgtcgggtctccgaggtcctgaacgtgaaccggagtctgtaattagtaactgacgaggtntaatataacgaatcanactaactattattcgtcgttagggcgttacggaaccgtaaagttacgtaccgtacccgttacgttacggttaccaacgacccaaccggacccaaccccgttatccgttctaacccg

SEQ ID NO: 402664 - DNA, 570 bp, Homo sapiens
  misc_feature: GZ8MTXP01AQA57.21.12.B01.1.454.CMB.2.raw
  modified_base (244)..(244): a, c, t, g, unknown or other
  modified_base (301)..(301): a, c, t, g, unknown or other
  modified_base (431)..(431): a, c, t, g, unknown or other
  modified_base (448)..(448): a, c, t, g, unknown or other
  modified_base (458)..(458): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcacgtggaaccagcggtgacgttgtcttangactatgtctcctggtacaacaacacccaggacaaacgccccaactcatctatttangatgtacagtaatccggccctagttacggggtttctaagtcgtacttctctcggctacagtctgaacaacgcgcctccgtgaccatctcgtcgggcctcgaggctagatgacgaggtctagtattatacngacgtaggggtacatanacaatcgaanacaaactgttatcgttcgtcgggtaacgtaacgggacacgttcgtaccgtaccgttacgttacgttccgaaccgacccgaaccggcccaacccgactcggttaactaacccg

SEQ ID NO: 402665 - DNA, 725 bp, Homo sapiens
  misc_feature: GZ8MTXP01C834R.21.12.B01.1.454.CMB.2.raw
  modified_base (246)..(246): a, c, t, g, unknown or other
  modified_base (304)..(304): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactggaaccagcggtgtacgttggtctttangactatgtctctagtaacaacaacaccaggacaaacgaccccaaactcatctatttangatgtactagtaactccggcctacggttaggggtttactaacgttcgtcttcgtcgtacggtcctacgaagtcgtacggtaacccaaacgtaaccgggtcccctcccgtacggaacccctactccgttcgtcgggtcccttaccgacggtcgtagacgtacggaacggtacggtacttaggtaatttacgttaaccgttaggaccgtaacgggggttaactaaagttaaactaaactaaacgtaccgaaacgtaaccgtaaaaccttaacgtttaacggttacggttaccggttaaccggggtaacggtaacgggggaaacctaaacggttaccgtacccgtaacccggttaccgttacggaccgtaaccggaacccgaacccggtaccccaccccgttaactccgttaacccttaacccg

SEQ ID NO: 402666 - DNA, 746 bp, Homo sapiens
  misc_feature: GZ8MTXP01AYXYC.21.12.B01.1.454.CMB.2.raw
  modified_base (195)..(195): a, c, t, g, unknown or other
  modified_base (206)..(206): a, c, t, g, unknown or other
  modified_base (250)..(250): a, c, t, g, unknown or other
  modified_base (276)..(276): a, c, t, g, unknown or other
  modified_base (323)..(323): a, c, t, g, unknown or other
  modified_base (455)..(455): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacngtcgatcaccntcctctgcacgtggaaccaggtccggtgtacgttggtactttangactatcgtctccgtaggaacctaanaactacccgacggacaaaccgacccccaaactcgactcttatttaangtacgttacgtagtaacgttaacgtccggtcccttaggttacgggggtttaccttaatccgtctttcgacgtttcggccttacgacggtctacggaacctaaaccgcccggtcccttacccggacgtaaccncttcgtcggttcgggaaacccttcccggaaaggtccggtacgtacggtacggtacggtacggtacgttacgttaacgttacgttacgtacgtacgtacggtaacgtaactaactaacgtaactaacgtaacgtaacgtaaccttaacgttacgttacggttaccgggttacgggtaacggtaacggttaaccgtaaacgttacgtacccgtacccgttaccggttacggttaccgtaacccgtacccgaacccgtacccgtacccgttaccgtaaccgttaaccgtaaccg

SEQ ID NO: 402667 - DNA, 572 bp, Homo sapiens
  misc_feature: GZ8MTXP02IETIE.21.12.B01.1.454.CMB.2.raw
  modified_base (374)..(374): a, c, t, g, unknown or other
  modified_base (434)..(434): a, c, t, g, unknown or other
  modified_base (442)..(442): a, c, t, g, unknown or other
tcagtcgtcgctcgcacgaccggtgctcgatttagtagtgtagattcggcgggggggtctcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcggtgacgttggtctttatgactatcgtctctggtaccaacaatacccaggacaaacgcccccaaatcatcaatttatgatgtcagtaatccggccctgaggggtttctaaatcgtacttctcgtccggctaccaagtctgacaacncggcctcctgaccatctctgggcctcaggctgatgacgaggctagattatactgcaggtntaatatanaatcagacaaactattatgttacgtacgggtactacgggaaccaaagtacgtaccgtaacccgttccgttaaggccaaaccgacccgaaacggacccccaaaacccgtacgtaccggttacctaaccccg

SEQ ID NO: 402668 - DNA, 771 bp, Homo sapiens
  misc_feature: GZ8MTXP02IYEX8.21.12.B01.1.454.CMB.2.raw
tcagtcgtcgctcgcacgaccggtgctcgatttagtagtgtagattcggcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaggcggtgacgtttggtctttatgacttatgtctcctggtaccaacaataccaggacaaacgcccccaaactcatacatttatgatgtcaagtaatcggccctcgtaggggtttactaagtacgtcttctctcggtcctacctagtcgttcggaccaacgaccgggccccttaccccgtacgtaacccctaacttcccgtaccggtttacggggcccttacccgtaagggtcccgttaggtaacgttacgggtaaacgggacggggtaccttacgggttaaatttaaacgtttacgttaggtaacccgttaagggggttaacccttaaaagttaaacttaaacccgtaaaagttaccccgaaagtaaccctaaaaccgttaccctttaaaagtttcggtttaaccgtttaccgggggtaaacccggtttacgggggaaaaccctaacggtaaacgttacccgtaacccgttacccgtaaggggttaccaacggtaaccccgaaacggggacccccaaaacccgtccggttacgtacccgtttaaacccg

SEQ ID NO: 402669 - DNA, 624 bp, Homo sapiens
  misc_feature: GZ8MTXP02JNGE6.21.12.B01.1.454.CMB.2.raw
  modified_base (246)..(246): a, c, t, g, unknown or other
tcagtcgtcgctcgcacgaccggtgctcgatttagtagtgtagattcggcggggggggtctcaggaggcagcgctctcgggacgtctccaccatggcctgggctctgctacttcctcaccctcctcactcagggcacagggtcctgggcccagtctgccctgactcagcctgcctccgtgtctgggtctcctggacagtcgatcaccatctcctgcactggagccagcggtgacgttggtctttangactatgtctcctggtaccaacaactaccaggacaaacgcccccaaactcaatcaatttatgatgtacagtaactcggccctcgtagggtttctaagtcgtacttctcccgtggcctacaagtcgtaggacaccgccggcctccctgacctatctcgtcgggccttcgacgctgacgtagacgagtctagtatttacgttacgtgaccgtaggttaccaattaactaaactaaactccgaaacgtacctaaactaacttaacgttcgtacgttacggggacgttacgggaaaccctaaaggtactaccgtaacccggttccgtaaggtaaccgaacgaaccccggaacggacccctaaacccgtaacttccgtaaccc

SEQ ID NO: 402670 - DNA, 612 bp, Homo sapiens
  misc_feature: GZ8MTXP02IMF63.21.12.B01.1.454.CMB.2.raw
  modified_base (224)..(224): a, c, t, g, unknown or other
  modified_base (249)..(249): a, c, t, g, unknown or other
  modified_base (313)..(313): a, c, t, g, unknown or other
  modified_base (326)..(326): a, c, t, g, unknown or other
  modified_base (414)..(414): a, c, t, g, unknown or other
  modified_base (466)..(466): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctctgcacgtggaaccnggcggttgtacggttgttactttancgtactatgtctcctaggtaccaaacaactaccaggacaaacgacccccaaatcatctatttangatgacagtaacncgacctcgtagggtttactaatccgtcttctcgtcggtcctacgaacgttcgtcggaccaacacccggtccttaccctacgaaccctnttcgtcgtagggtccctccgagtctggatcgacgaggctagtaacttatacngtacgtagtataatataactaactacaacgtaactaacttactacgttacgtcggtacggtacgacggtaactaaacgtacgtaccgtaccgtacgtacgaccgaacccgaaccgaaccgaccccaaaccgtactacctacctccg

SEQ ID NO: 402671 - DNA, 413 bp, Homo sapiens
  misc_feature: GZ8MTXP02GEMW7.21.12.B01.1.454.CMB.2.raw
  modified_base (408)..(413): a, c, t, g, unknown or other
tcagtcgtcgctcgcacgaccggtgctcgatttagtagtgtagatttggctttgggagcagctccaacatcgggtcaccttttgatgtgcactggtatcagcaacttccaggaacagccccccaaactcctcatctatggtaacagcaatcggccctcaggggtccctgaccgattctctggctccaagtctggcacctcagcctcctggtcatcgctgggctccaggctgacgatgaggctgattatattgccagtcctatgacaacaccctgcgttggtttttaggctggtttcggcgggcggaccaagctgaccgtctaggtcagcccaaggctcgcccctcgtccactctcgttcccaccccttcctccgagcgacgactgagcgggctgacaaggcgcatagnnnnnn

SEQ ID NO: 402672 - DNA, 623 bp, Homo sapiens
  misc_feature: GZ8MTXP02JZOIQ.21.12.B01.1.454.CMB.2.raw
  modified_base (226)..(226): a, c, t, g, unknown or other
  modified_base (246)..(246): a, c, t, g, unknown or other
  modified_base (251)..(251): a, c, t, g, unknown or other
  modified_base (253)..(253): a, c, t, g, unknown or other
  modified_base (263)..(263): a, c, t, g, unknown or other
  modified_base (292)..(292): a, c, t, g, unknown or other
tcagtcgtcgctcgcacgaccggtgctcgatttagtagtgtagattcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccnggcggtgtacgttgtcttangactntntctctgacanacaccagacaacgcccaatcatcattatnatgcagtaacgcgtccctagtaggttactagtcgtcttctctcggcctacgtagtcgtcgaccaccgtccgggcccttcccgtacacctagtccctcgtacgggaccctccggtacgtccgtaggtactcggaaacggcgtacgtagttaatttacgttacgtagacgttacggaactactaactaacaaccgttacaacgaccttaacttaacgttacttacggtacgtacggtaaccggttacgggaacctaaggtaccgtaccgtaccgtacgtacgtaccgaacgaacccggtacgaacccctacccgacgtcccgtaacttacccg

SEQ ID NO: 402673 - DNA, 536 bp, Homo sapiens
  misc_feature: GZ8MTXP01DIQW9.11.13.B02.1.454.CMB.2.raw
  modified_base (519)..(519): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatcgacgttggagtcagggaactctgggtccaccgtctcctcacgccctccaccaacgggcccatccggtccttccccctggccgccctcgctccacggacggccacctccgagacgcacagccggccctgggcctgcctggtcaaggacttacgttccgtattcttcttcgctgngcgggcttggcaaggcg

SEQ ID NO: 402674 - DNA, 558 bp, Homo sapiens
  misc_feature: GZ8MTXP01EKJN4.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaagggctggagtgggtggccaacataaagccagatggaggtagtaaaacagtatgtagactctgtggagggccggttcaccatctccagagacaacgcaaagaatgcgatatatctacagatgaacagcctgccgagcgagacacggctgtgtattacgtgtgggagtccctggctggcacctgtactccgacgttggagtcagggactctgtcacgtctctcacgcctccaccgacgggcccagtccggtcccttccccgtggcccgtccctgcctccgaggacgcccaacccgttccggaacgcgccgaaccgcggcccgggttcccctgggggttcctccggg

SEQ ID NO: 402675 - DNA, 520 bp, Homo sapiens
  misc_feature: GZ8MTXP01BF419.11.13.B02.1.454.CMB.2.raw
  modified_base (446)..(446): a, c, t, g, unknown or other
  modified_base (473)..(473): a, c, t, g, unknown or other
  modified_base (483)..(483): a, c, t, g, unknown or other
  modified_base (501)..(501): a, c, t, g, unknown or other
  modified_base (504)..(504): a, c, t, g, unknown or other
  modified_base (506)..(506): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctgggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccggttcaccatctccagagacaacgccaagaatgcgatatatctacagatgaacagcctgccgagccgaggacacggctgtgtattactgtgggagtccctgggctggcacctgtatccgaccgttggagtcagggaactctggtcaccgtctcctcacgcctccnccaaggcccatcggtcttcccctggcnccctgctccnggacgcaccgttccgagngcncngcggccctggctcg

SEQ ID NO: 402676 - DNA, 529 bp, Homo sapiens
  misc_feature: GZ8MTXP01ANAKV.11.13.B02.1.454.CMB.2.raw
  modified_base (368)..(368): a, c, t, g, unknown or other
  modified_base (506)..(506): a, c, t, g, unknown or other
  modified_base (511)..(511): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctgggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccggttcaccatctccagagacaacgccaagaatgcgatatatctacagatgaacagcctgccgagcgaggacacggctgtgtattacngtgggagtccctggctggcaccgtgtactccgaccgttggagtcagggaactcgtggtcaccgtctctcagccctcaccaagggcccatccggtccttcccctggccgccctgctcccaggacgccaccgttccgagncaacncgcggcccgtgggctcgg

SEQ ID NO: 402677 - DNA, 525 bp, Homo sapiens
  misc_feature: GZ8MTXP01EUQCQ.11.13.B02.1.454.CMB.2.raw
  modified_base (502)..(502): a, c, t, g, unknown or other
  modified_base (508)..(508): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggagtgtaaaacagtatgtagactctgtggagggccggttcaccatctccagagacaacgccaaagaatgcgatatatctacagatgaacagcctgccgagcgaggacacggctgtgtattactgtgggagtccctggctggcacctgtatcccacgttggagtcagggaactctggtcaccgtctcctcagccctcaccaaggcccatccgtcctcccctgcgccctgcctccaggacgcaccgttccgagngcaacngcggccctggggctcgg

SEQ ID NO: 402678 - DNA, 594 bp, Homo sapiens
  misc_feature: GZ8MTXP01BI3II.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattacgtgtgggagtcctggctggcactgtactcgacgttggagtcgagggaactcgtggtcaccgtctcctcacgccctccaccaacgggccccagtccggtccttcccccgtggcccgccccttgcctccgacgggacggccacccgtccgaacgacgccacgacggcccgggcccgtgggggccttcggcccgtgggtccgaaacgggtaccttacgtttccccggtattcccttcgttccggtcctggaacggccggggcgttcgggccgaagggccg

SEQ ID NO: 402679 - DNA, 530 bp, Homo sapiens
  misc_feature: GZ8MTXP01BQ9GG.11.13.B02.1.454.CMB.2.raw
  modified_base (260)..(260): a, c, t, g, unknown or other
  modified_base (372)..(372): a, c, t, g, unknown or other
  modified_base (510)..(510): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacngtatgtagactctgtggagggccggttcaccatctccagagacaacgccaaagaatgcgatatatctacagatgaacagcctgccgagccgaggacacggctgtgtattacngtggggagtccctggctggcacctgtatccgaccgttggagtcagggaactcgtggtcaccgtctcctcacgcctccaccagggcccagtccggtccttcccctggccgccctgcctccaggacgcaccgttccgagngcaacagcggcctgggctcg

SEQ ID NO: 402680 - DNA, 535 bp, Homo sapiens
  misc_feature: GZ8MTXP01D6BK1.11.13.B02.1.454.CMB.2.raw
  modified_base (495)..(495): a, c, t, g, unknown or other
  modified_base (513)..(513): a, c, t, g, unknown or other
  modified_base (519)..(519): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacagtatgtagactctgtggagggccggttcaccatctccagagacaacgccaaagaatgcgatatatctacagatgaacagcctgccgagcgaggacacggctgtgtattactgtgggagtccctggctggcacctgtatccgaccgttggagtcagggaactctggtcaccgtctcctcacgccctccaccgaacgggcccatccggtccttccccctcggccgccctgctccnggacgcaccgttccgagngcaacncgcggcccgtggcgtg

SEQ ID NO: 402681 - DNA, 565 bp, Homo sapiens
  misc_feature: GZ8MTXP01BB8HN.11.13.B02.1.454.CMB.2.raw
  modified_base (329)..(329): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggattccnggctggcacctgtatccgacgttggagtcagggaactcgtggtccaccgtctcctcacgccctccaccaacgggcccagtccggtcccttcccccgtggcccgccctgccctccgacgggacggccaccgtccgagacgcacgacgccggcccgtgggcctcgcccgtggtccaaagggtccttaccgttcccgtattccgttccttcgcctggcgcggggcttgggcgaaggccg

SEQ ID NO: 402682 - DNA, 523 bp, Homo sapiens
  misc_feature: GZ8MTXP01EIAS8.11.13.B02.1.454.CMB.2.raw
  modified_base (486)..(486): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgccgagccgaggacacggctgtgtattactgtgggagtcccctggctggcacctgtatccgaccgttggagtcagggaactctggtcaccgtctcctcacgcctccaccaagggcccatcggtcttcccctgcgccctgctccngagcaccgttccgagaagcaacagcgccctgggctcg

SEQ ID NO: 402683 - DNA, 563 bp, Homo sapiens
  misc_feature: GZ8MTXP01DMYF1.11.13.B02.1.454.CMB.2.raw
  modified_base (496)..(496): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtgcaacataaagccagatggaggtagtaaaacagtatgtagactctgtggagggccggttcaccatctccagagacaacgccaagaatgcgatatatctacagatgaacagcctgccgagcgaggacacggctgtgtattacgtggtgggactccctggctggcacctgtactccgaccgttggagtcgagggaactcgtggtcaccgttctcccttcgacgccctacccaaccgacgggcccacgtccggtcccttcccccgtggcccnccctcgccttccgacggacgccacccgttccgacgaacgcaacgacggccggcccgtggggctccgg

SEQ ID NO: 402684 - DNA, 537 bp, Homo sapiens
  misc_feature: GZ8MTXP01CH7ML.11.13.B02.1.454.CMB.2.raw
  modified_base (444)..(444): a, c, t, g, unknown or other
  modified_base (478)..(478): a, c, t, g, unknown or other
tcagcgagagataccacgaccggtgctcgatttagtctagcgactttgggttctccttgttgctattttagaaggtgtccaatgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtagtaaaacagtatgtagactctggtggagggccggttcaccatctccagagacaacgccaaagaatgcgatatatctaacagatgaacagcctgccgagcgaggacacggctgtgtattacgtggtgggagtccctggctggcacctgtactccgacgttggacgtcgaggactctggtcaccgtctcctcncgcctccaccagggcccagtccgtccttccccgngcccgccctgcctcgcggacgcaccgttcgagaacgcaacgcgccgcccgtgggctcgg

SEQ ID NO: 402685 - DNA, 541 bp, Homo sapiens
  misc_feature: GZ8MTXP01A5SFE.11.13.B02.1.454.CMB.2.raw
  modified_base (260)..(260): a, c, t, g, unknown or other
  modified_base (385)..(385): a, c, t, g, unknown or other
  modified_base (521)..(521): a, c, t, g, unknown or other
  modified_base (523)..(523): a, c, t, g, unknown or other
tcagcgagagataccacgaccggtgctcgatttagtctagcgactttgggttctccttgttgctattttagaaggtgtccaatgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacngtatgtagactctgtggagggccggttcaccatctccagagacaacgccaagaatgcgatatatctacagatgaacagcctgcccgagccgaggacacggctgtgtattactgtggggagtcccnggctggcacctgtatccgaccgttggagtcagggaactctggttcaccgtctcctcacgcctccacccaacgggcccacgtccggtccttccccctggcccgccctgcctcccaggacgccaccgttccgagaacncnccagcggccctgggctcg

SEQ ID NO: 402686 - DNA, 541 bp, Homo sapiens
  misc_feature: GZ8MTXP01A6F7S.11.13.B02.1.454.CMB.2.raw
  modified_base (518)..(518): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatgggaggtgtaaaacagtatgtagactctgtggagggccggttcaccatctccagagacaacgccaaagaatgcgatatatctacagatgaacagctgccgagccgaggacacggctgtgtattacgtgtgggagtccctggctggcactgtatccgaccgttggagtcgagggactctggtcaccgtctcctcacgcctccaccgaacgggccccagtccgtccttcccccgtggcccgtccctgcctccaggacgcacccgttcgagaacncaacgcgccggccctgggcgtcg

SEQ ID NO: 402687 - DNA, 561 bp, Homo sapiens
  misc_feature: GZ8MTXP01EEPVI.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctggagtgggtggccaacataaagccagatggaggtagtaaaacagtatgtagactctgtggagggccggttcaccatctccagagacaacgccaaagaatgcgatatatctacagatgaacagcctgccgagcgaggacacggctgtgtattactggtgggacgtccctggctggcacctgtactccgacgtttggagtcgagggaactcgtggtcaccgtctcctcacgccctccaaccgaacgggccccagtccggtcccttcccccgtggcccgccctgcctcccgaggacgccacccgttccgagaacgcaacgcggccggcccgtcggggctccgg

SEQ ID NO: 402688 - DNA, 515 bp, Homo sapiens
  misc_feature: GZ8MTXP01DZW1J.11.13.B02.1.454.CMB.2.raw
  modified_base (235)..(235): a, c, t, g, unknown or other
  modified_base (373)..(373): a, c, t, g, unknown or other
  modified_base (463)..(463): a, c, t, g, unknown or other
  modified_base (467)..(467): a, c, t, g, unknown or other
  modified_base (496)..(496): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgagggaagggctggagtgggtgccaanataaagccagatggaggtgtaaaacagtatgtagactctgtggagggccggttcaccatctccagagacaacgccaaagaatgcgatatatctacagatgaacagcctgccgagtcgaggacacggctgtgtattacngtgggagtccctggctggcactgatccgaccgttggagtcagggaactctggtcaccgtctcctcagcctccacaggccatcgtctcccngccncctgctcagcgcaccgcgagaacgcaacncgccggccctggggctcgg

SEQ ID NO: 402689 - DNA, 573 bp, Homo sapiens
  misc_feature: GZ8MTXP01DU96L.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggagggctggagtgggtgcaacataaagccagatggaggtagtaaaacagtatgtagactctggtggagggccgttcaccatctccagagacaacgccaaagaatgcgaatatatctacagatagaacagcctgccgagccgaggacacggctgtgtattacgtggtgggacgtcccgtgggcctggcaccgtgtactcccgtaccggttggagtcgagggaactcgtggtcacccgtctcctcacgccctaccaccgaacgggcccctacgtcccgtcccttcccccgtggccccgtccctcgccctccgaggacgccacccgttccgacgcgcaaccgcggccggcccgtcgggcgtccgg

SEQ ID NO: 402690 - DNA, 583 bp, Homo sapiens
  misc_feature: GZ8MTXP01C82UQ.11.13.B02.1.454.CMB.2.raw
tcagcgagagataccacgaccggtgctcgatttagtctagcgactttgggttctccttgttgctattttagaaggtgtccaatgtgaggcgcagatggtggggtctgggggaggcttggtccagcctggggggtccctgagactctcctgtacagcctctggattcagcatcagttcgtattggatgaattgggtccgccaggctccgagggaaggggctgggagtgggtggccaacataaagccagatggaggtgtaaaacagtatgtagactctgtggagggccggttcaccatctccagagacaacgccaaagaatgcgatatatctacagatgaacagctgccgagcgagacacggctgtgtatactggtgggatcccgtggctggcactgtatccgtaccgttggagtcgagggaactcgtcggtccaccgtctccctcacgccctaccaacccgaacggggcccctacgtcccggttcccttccccccgtgggcccgtccccttgccctcccgacgggacgccacccgttccggacgaacgccgaaccgacggcccggccccgttggggcctccggg

SEQ ID NO: 402691 - DNA, 565 bp, Homo sapiens
  misc_feature: GZ8MTXP01CYD3B.11.13.B02.1.454.CMB.2.raw
  modified_base (506)..(506): a, c, t, g, unknown or other
  modified_base (512)..(512): a, c, t, g, unknown or other
  modified_base (528)..(528): a, c, t, g, unknown or other
  modified_base (539)..(539): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaattgggtccgccaggctccgaggggaaggggctgggagtgggtggccaacataaagccagatggaggtagtaaaacagtatgtagactcgtggtggagggccggttcaccatctccagagacaacgccaaagaatgcgatatatctacagatagaacagctgccgagccgaggacacggctgtgtattacgtggtggggacgtcccgtgggctggcctaccgtgtacgtccggaccgttgggacgtcgaggggaactcgtggtccaccgtctccctcacgccctaccaccgacgggcccagtccgtcccttccccgnggcccncctcgctccgaggacnccaccgcgagngcaacgcggccggcccgtgggctcgg

SEQ ID NO: 402692 - DNA, 561 bp, Homo sapiens
  misc_feature: GZ8MTXP01BXHQY.11.13.B02.1.454.CMB.2.raw
  modified_base (238)..(238): a, c, t, g, unknown or other
  modified_base (264)..(264): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaattgggtccgccaggctccgaggggaaggggctgggagtgggtgccaanataaagccagatggaggtgtaaaacngtatgtagactctggtggagggccggttcaccatctccagagacaacgcaaagaatgcgatatatctaacagatgaacagcctgccgagcgaggacacggctgtgtattacgtggtgggagtcccgtgggctggcaccgtgtacgtccgaccggttggacgtcgagggaactcgtggtcaccgtctcctcacgcctaccaccgaacggcccacgtccggtcccttccccgtcggcccgccctcgccgtcgaggacgccacccgccgagaacgcaacgcgccggcccgtgggccgtcg

SEQ ID NO: 402693 - DNA, 541 bp, Homo sapiens
  misc_feature: GZ8MTXP01EUHVQ.11.13.B02.1.454.CMB.2.raw
  modified_base (261)..(261): a, c, t, g, unknown or other
  modified_base (483)..(483): a, c, t, g, unknown or other
  modified_base (522)..(522): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaagggctggagtgggtggccaacataaagccagatggaggtgtaaaacngtatgtagactctggtggagggccggttcaccatctccagagacaacgccaaagaatgcgatatatctacagatgaacagcctgccgagcgagacacggctgtgtattactgtgggacgtcccgtggctggcacctgtactccgacgttggagtcgagggactcgtgtcaccgtctcctcacgccctccaccgaacgggcccagtccgtcctccccgtgccnccctgctccgacggcgcccaccgttccgagaacgcaacncggccgccgtggccgtcgg

SEQ ID NO: 402694 - DNA, 551 bp, Homo sapiens
  misc_feature: GZ8MTXP01CRZE6.11.13.B02.1.454.CMB.2.raw
  modified_base (520)..(520): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattggtccgccaggctccaggagggctggagtggtggcaacataaagccagatggaggtgtaaaacagtatgtagactctgtggagggccggttcaccatctccagagacaacgccaagaatgcgatatatctacagatgaacagcctgccgagcgaggacacggctgtgtattactggtgggacgtcccgtggctggcacctgtactccgaccgttggagtcgagggaactcgtggtccaccgtctcctcacgccctccaccgaacggcccactccgtccttccccctggcccgccctcgcctccgacggacgccaccgttccgacgaacncaaccgaaccggccttcgggccgttcgcccg

SEQ ID NO: 402695 - DNA, 578 bp, Homo sapiens
  misc_feature: GZ8MTXP01ER4HT.11.13.B02.1.454.CMB.2.raw
  modified_base (207)..(207): a, c, t, g, unknown or other
tcagcgagagataccacgaccggtgctcgatttagtctagcgactttgggtctgggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgcaaagatgcgatatatctacagatgaacagcctgcgagccgaggacacggctgtgtattacgtggtgggacgtccctggctggcaccgtgtactcgacgttggagtcagggaactcgtgggtcaccgtctcctcacgccctccaccaacgggcccatccggtccttcccccgtggcccgccctcgcctacccgacggacggccacccgtccgaacgacgccacgacggccggcccgtggggcctcggccctgggtacaaacgggtaccttaccgttccgttattccgttcttcgcttggaacggcgggcttcgggcgaagggcg

SEQ ID NO: 402696 - DNA, 533 bp, Homo sapiens
  misc_feature: GZ8MTXP01EZEGQ.11.13.B02.1.454.CMB.2.raw
  modified_base (234)..(234): a, c, t, g, unknown or other
  modified_base (260)..(260): a, c, t, g, unknown or other
  modified_base (371)..(371): a, c, t, g, unknown or other
  modified_base (384)..(384): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgagggagggctggagtgggtgccaanataaagccagatggaggtgtaaaacngtatgtagactctggtggagggccggttcaccatctccagagacaacgccaaagatgcgatatatctacagatgaacagcctgccgagcgaggacacggctgtgtattacnggtgggattcccnggctggcacctgtatccgacgttggatcgagggactctggtcaccgtctctcacgcctccaccgaacgggcccagtccggtccttcccccgtggcccgccctcgcctccgagcgcacccgcgacgcgcaacgcgcgccctggggctcgg

SEQ ID NO: 402697 - DNA, 542 bp, Homo sapiens
  misc_feature: GZ8MTXP01A5UNQ.11.13.B02.1.454.CMB.2.raw
  modified_base (525)..(525): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctgggggtccctgagactctcctgtacagcctctggattcagcatcagttcgtattggatgaattgggtccgccaggctccagggaagggctgggagtgggtggccaacataaagccagatggaggtgtaaaacagtatgtagactctgtggagggccggttcaccatctccagagacaacgccaaagaatgcgatatatctacagatgaacagcctgccgagccgaggacacggctgtgtattactgtggggatccctgggctggcacctgtactccgaccgttggagtcagggaactctggtcaccgtctccgtcacgcctccaccaacgggcccatccggtccttccccctggccgccctcgcctccgacggacgccaccgttccgacgaagcaacgngccggccctgggctcgg

SEQ ID NO: 402698 - DNA, 539 bp, Homo sapiens
  misc_feature: GZ8MTXP01B7MAP.11.13.B02.1.454.CMB.2.raw
  modified_base (258)..(258): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggagggctggagtgggtgccaacataaagccagatggaggtgtaaaacngtatgtagactctggtggagggccggttcaccatctccagagacaacgccaagaatgcgatatatctacagatgaacagcctgccgagcgaggacacggctgtgtattactggtgggagtccctggctggcacctgtatccgacgttggagtcagggactcgtggtcaccgtcgtcctcacgccctccaccgaacgggcccagtccggtccttccccctggccgccctgacctccaggcgcacccgttccgacgcgcaacgcggccggccctgggcctcgg

SEQ ID NO: 402699 - DNA, 514 bp, Homo sapiens
  misc_feature: GZ8MTXP01ESS1O.11.13.B02.1.454.CMB.2.raw
  modified_base (382)..(382): a, c, t, g, unknown or other
  modified_base (476)..(476): a, c, t, g, unknown or other
  modified_base (485)..(485): a, c, t, g, unknown or other
  modified_base (487)..(487): a, c, t, g, unknown or other
  modified_base (496)..(496): a, c, t, g, unknown or other
  modified_base (501)..(501): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacagtatgtagactctggtggagggccgttcaccatctccagagacaacgccaaagaatgcgataatatctacagatgaacagcctgccgagccgaggcacggctgtgtatactgtgggatcccnggctggcacctgtatccgacgttggagtcagggaactcgtggtcaccgtctcctcagccctccaccgaacggcccatcggtcctcccctggccnccctgctcngngcacgcagncaacngcgcctgggctcg

SEQ ID NO: 402700 - DNA, 610 bp, Homo sapiens
  misc_feature: GZ8MTXP01DXKRS.11.13.B02.1.454.CMB.2.raw
  modified_base (106)..(106): a, c, t, g, unknown or other
  modified_base (203)..(203): a, c, t, g, unknown or other
  modified_base (268)..(268): a, c, t, g, unknown or other
  modified_base (550)..(550): a, c, t, g, unknown or other
  modified_base (589)..(589): a, c, t, g, unknown or other
tcagcgagagataccacgaccggtgctcgatttagtctagcgactttgggttctccttgttgctattttagaaggtgtccagtgtgaggcgcagatgggtggggtntggggggaggcttggtccagccgtgggggggtccctgagactctcctgtacagcctctggattcagcatcagttcgtattggatgaagttgggtccnccaggctcgaggggaagggctgggaggtgggtgacaacataaagcagatgggaaggtagtaaaanagtatgagactgtggtgggacgggccgttcaccatctccaagagaacaacgacaaagaatgcaatatatctaacagatacgaacacgcctggcccggacggaccggaaggacctacggtcttagtggttaattacggtgggtcggggtaccgtcccgtgggtcctcggcctacgtgtactcccggtacggttggacgtacgaagggacttcgtcggtacctaccgtcctcctcgaccgtcccaccaaccgaccggccctacgtcccggttccccttccccgnggcccgccctgcccgtacgagacgccaccgttcggagcncaacgcgccggccgtggctcg

SEQ ID NO: 402701 - DNA, 572 bp, Homo sapiens
  misc_feature: GZ8MTXP01EFJRY.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtagtaaaacagtatgtagactctgtggagggccggttcaccatctccagagacaacgccaaagaatgcgatatatctacagatgaacagcctgccgagccgaggacacggctgtgtattacgtgtgggagtccccgtgggctggcactgtactccgacgttggagtcgagggactcgtgtccaccgtctcctcacgccctaccaccgaacggccctagtccggtcccttcccccgcggcccgccctcgcctcccgaagggacgcccaacccgttccgaacgaacgaccgaaccgacggcccggcccgtcgggccgtccggg

SEQ ID NO: 402702 - DNA, 561 bp, Homo sapiens
  misc_feature: GZ8MTXP01CXHJR.11.13.B02.1.454.CMB.2.raw
  modified_base (536)..(536): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccggttcaccatctccagagacaacgccaaagaatgcgatatatctacagatgaacagcctgccgagcgaggacacggctgtgtattacgtggtggggagtcccctggctggcacctgtactcccgaccgttggagtcgaagggaactcgtggtcctaccggtcttccctcaacgccctacccacccgaaacgggccccacgtccgtccttcccccgtggcccgccctcgctccgacggacgcaccgttccgagngcaacgacgccggccctgggctcgg

SEQ ID NO: 402703 - DNA, 523 bp, Homo sapiens
  misc_feature: GZ8MTXP01AQQSW.11.13.B02.1.454.CMB.2.raw
  modified_base (260)..(260): a, c, t, g, unknown or other
  modified_base (476)..(476): a, c, t, g, unknown or other
  modified_base (485)..(485): a, c, t, g, unknown or other
  modified_base (490)..(490): a, c, t, g, unknown or other
  modified_base (501)..(501): a, c, t, g, unknown or other
tcagcgagagataccacgaccggtgctcgatttagtctagcgactttgggttctccttgttgctattttagaaggtgtccagtgtgaggcgcagatggtgggtctggggaggcttggtccagcctggggggtccctgagactctcctgtacagcctctggattcagcatcagttcgtattggatgaattgggtccgccaggctccagggaaggggctgggagtgggtggccaacataaagccagatggaggtgtaaaacngtatgtagactctgtggaggccggttcaccatctccagagacaacgccaaagaatgcgatatatctacagatgaacagcctgccgagccgaggacacggctgtgtattactgtgggagtccctggctggcacctgtactccgaccgttggagtcagggaactcgtggtcaccgtctctcagccctccaccgaaggcccagtcgtcctcccctgccncctgctccnggacncaccttcgagngcaacgagccggcctggcgtcg

SEQ ID NO: 402704 - DNA, 573 bp, Homo sapiens
  misc_feature: GZ8MTXP01AY84H.11.13.B02.1.454.CMB.2.raw
  modified_base (264)..(264): a, c, t, g, unknown or other
tcagcgagagataccacgaccggtgctcgatttagtctagcgactttgggtcctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtgtaaaacngtatgtagactctggtggagggccggttcaccatctccagagacaacgccaaagaatgcgatatatctacagatgaacagcctgcgagcgaggacacggctgtgtattacgtggtggggacgtccccgtgggccgtggccaccgtgtacgtcccgaccggtttggagtcgagggtaactcgtcggtcaccgtctcctcacgccctccaccgaacggcccacgtccggtcccttcccccgtggcccgcccctcgcctccgacggacgcccaccgttccgagcgcaacgcggccggccccgtgggcgtcgg

SEQ ID NO: 402705 - DNA, 539 bp, Homo sapiens
  misc_feature: GZ8MTXP01BPOGM.11.13.B02.1.454.CMB.2.raw
  modified_base (486)..(486): a, c, t, g, unknown or other
  modified_base (523)..(523): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgccgagcgaggacacggctgtgtattactgtgggagtccctggctggcacctgtatccgaccgttggagtcagggaactcgtggtcaccgtctcctcacgccctccaccgaacgggccccagtccggtccttccccctggccnccctgcctccaggacgcacccgttccgagaagcaacncgcggccctgggctcg

SEQ ID NO: 402706 - DNA, 547 bp, Homo sapiens
  misc_feature: GZ8MTXP01C8FF5.11.13.B02.1.454.CMB.2.raw
  modified_base (201)..(201): a, c, t, g, unknown or other
  modified_base (238)..(238): a, c, t, g, unknown or other
  modified_base (303)..(303): a, c, t, g, unknown or other
  modified_base (350)..(350): a, c, t, g, unknown or other
  modified_base (378)..(378): a, c, t, g, unknown or other
  modified_base (490)..(490): a, c, t, g, unknown or other
  modified_base (496)..(496): a, c, t, g, unknown or other
  modified_base (530)..(530): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaattgggtccnccaggctccgaggggaagggctgggagtgggtgcaanataaagccagatgggaggtagtaaaacagtatgtagactcgtggtggagggccggttcaccatcnccagagacaacgccaaagaatgcgatatatctacagatgaacagccngccgagcgagacacggctgtgtatacgnggtgggactccctggctggctacctgtactccgacgttggagtcgaagggaactcgtggtccaccgtctctcacgcctccaccgaacgggcccagtccggtccttcccccgnggcccnccctgcctccgagacgcaccgcgagaacgcaacncggccgccgtgggctcg

SEQ ID NO: 402707 - DNA, 564 bp, Homo sapiens
  misc_feature: GZ8MTXP01ERP1A.11.13.B02.1.454.CMB.2.raw
  modified_base (260)..(260): a, c, t, g, unknown or other
  modified_base (501)..(501): a, c, t, g, unknown or other
  modified_base (507)..(507): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacngtatgtagactctggtggagggccggttcaccatctccagagacaacgccaaagaatgcgatatatctacagatgaacagcctgccgagcgaggacacggctgtgtattactggtggggattcccgtgggctgggcaccgtgtactccggacgtttgggagtcgagggaactcgtggtccaccgttctcccttcacgccctccacccgaacgggcccacgttcccggtccctttcccccgnggcccnccctgcctccgaggcgccaccgttccggagcgcaacgcggccggccgtcgggctcgg

SEQ ID NO: 402708 - DNA, 539 bp, Homo sapiens
  misc_feature: GZ8MTXP01DTE9Y.11.13.B02.1.454.CMB.2.raw
  modified_base (235)..(235): a, c, t, g, unknown or other
  modified_base (514)..(514): a, c, t, g, unknown or other
  modified_base (520)..(520): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgagggagggctggagtgggtgcaanataaagccagatggaggtagtaaaacagtatgtagactctgtggagggccgttcaccatctccagagacaacgccaaagaatgcgatatatctacagatgaacagcctgccgagcgaggacacggctgtgtattacgtggtgggagtcccgtggctggctactgtatccgacgttggagtcagggaactcgtgtcaccgtctctcacgcctccaccacgggcccatccggtccttcccctcggccgccctcgcctccgaggacgccaccgttccgacgngcaacncgccggccgtcgggctcgg

SEQ ID NO: 402709 - DNA, 538 bp, Homo sapiens
  misc_feature: GZ8MTXP01ACVGH.11.13.B02.1.454.CMB.2.raw
  modified_base (233)..(233): a, c, t, g, unknown or other
  modified_base (259)..(259): a, c, t, g, unknown or other
  modified_base (369)..(369): a, c, t, g, unknown or other
  modified_base (383)..(383): a, c, t, g, unknown or other
  modified_base (484)..(484): a, c, t, g, unknown or other
  modified_base (518)..(518): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctggggggtccctgagactctcctgtacagcctctggattcagcatcagttcgtattggatgaattgggtccgccaggctccgagggaagggctggagtgggtgccaanataaagccagatggaggtgtaaaacngtatgtagactctgtggagggccgttcaccatctccagagacaacgccaaagaatgcgatatatctacagatgaacagcctgccgagcgagacacggctgtgtattacgnggtgggacgtcccngggctggcaccgtgtactccgacgttggagtcgagggaactctggtcaccgtctcctcacgccctccaccgaaggcccagtccggtccttccccgtggccnccctgcctccgaggacgcacccgttcgagaagcncgagccggcccgtgggctcg

SEQ ID NO: 402710 - DNA, 582 bp, Homo sapiens
  misc_feature: GZ8MTXP01EE2RT.11.13.B02.1.454.CMB.2.raw
  modified_base (534)..(534): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagccgtgggggggtccctgagactctcctgtacagcctctggattcagcatcagttcgtattggatgaattgggtccgccaggctccgaggggaaggggctggagtgggtggccaacataaagccagatgggaggtagtaaaacagtatgtagactctggtggagggccggttcaccatctccagagacaacgccaaagaatgcgatatatctacagatgaacagcctgccgagcgaggacacggctgtgtattacgtggtgggtacgtcccgtggctggctaccgtgtactccggaccgttggagtcgagggactcgtgtcaccgtcgtcctcacgccctaccacccgaacgggcccaacgttccggtcccttcccccgtcggcccgcccttcggacctcccgaggaccnccaacccgttccggagaacgcaaccgcggccggcccgtcgggctccgg

SEQ ID NO: 402711 - DNA, 574 bp, Homo sapiens
  misc_feature: GZ8MTXP01B7R1D.11.13.B02.1.454.CMB.2.raw
  modified_base (260)..(260): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggagggctggagtgggtgcaacataaagccagatggaggtagtaaaacngtatgtagactctggtggaggccggttcaccatctccagagacaacgccaaagaatgacgatatatctaacagatagaacagcctgccgagcgaggacacggctgtgtatacgtggtgggacgtcccgtggctggcaccgtgtacgtccggtaccggttggacgtcgaagggactcgtcggtctacccgtctcctcacgccctaccaccgaacgggccctacgtcccggttcccttcccccgtcggccctccccgtgccctccgaggacgccacccgttcgacggcgcaacgcggccggcccgtggggcctcgg

SEQ ID NO: 402712 - DNA, 580 bp, Homo sapiens
  misc_feature: GZ8MTXP01BWDWG.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctggtggagggccggttcaccatctccagagacaacgccaagaatgcgatatatctacagatgaacagcctgcgagccgaggacacggctgtgtattactggtgggagtccctggctggcacctgtactcgacgttggagtcagggaactcgtggtcaccgtctcctcacgccctccaccgaacgggcccacgtccggttcccttcccccgtcgggcccgccccgtcgcctccgacggacggccacccgtccgagacgccacgacgccggcccgtggggcctcggcccgtgggtcgaaacgggtccttaacgttcccgtacttccgttcttcgcctggaacgtcgggcgttggcgaaggcg

SEQ ID NO: 402713 - DNA, 544 bp, Homo sapiens
  misc_feature: GZ8MTXP01CUIO4.11.13.B02.1.454.CMB.2.raw
  modified_base (502)..(502): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaagggctggagtgggtggccaacataaagccagatgggaggtagtaaaacagtatgtagactctggtggagggccgttcaccatctccagagacaacgccaaagaatgcgatatatctaacagatgaacagcctgccgagccgaggacacggctgtgtattacgtggtgggatccctgggctggcactgtatccgacgtggagtcgagggactcgtgtcacccgtctcctcacgccctccaccgaacgggcccacgtccggtcccttccccgtggccgccctcgcctccnggacgcaacccgttcgagaagcaacgcgccggcctgggctcg

SEQ ID NO: 402714 - DNA, 604 bp, Homo sapiens
  misc_feature: GZ8MTXP01C3AKY.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtggccaacataaagccagatggaggtagtaaaacagtatgtagactctggtggagggccggttcaccatctccagagacaacgaccaaagaatgcgaatatatctacagatagaacagcctgccgagccgaggaccacggcttgtgtattacgtggtgggacgtcccgtggctggcaccgtgtactccgacggttggagtcgacgggaactcgtcggtccgaccgttctaccctcgacgccctaccaccgaacgggcccacgtccggttccccttcccccgtcgggcccgtccccgtcgcccgtccgacgggacgccgaacccgttccggaacgaacgcccgaacgacgggcccgggcccgtcggggcccgtcggg

SEQ ID NO: 402715 - DNA, 551 bp, Homo sapiens
  misc_feature: GZ8MTXP01DJH9V.11.13.B02.1.454.CMB.2.raw
  modified_base (258)..(258): a, c, t, g, unknown or other
  modified_base (371)..(371): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaagggctggagtgggtgcaacataaagccagatggagtgtaaaacngtatgtagactctgtggagggccggttcaccatctccagagacaacgccaaagaatgcgatatatctacagatgaacagcctgccgagccgaggacacggctgtgtattacgngtgggatccctggctggcaccgtgtactccgaccgttggacgtcgagggaactcgtacgggtcaccggttctccctcgacgccctaccaccgaacgggccccagttccggtcccttcccccgtggccgccctgcctccgagacgccacccgttcgacgcgcaacgcgcggcctgggctcg

SEQ ID NO: 402716 - DNA, 583 bp, Homo sapiens
  misc_feature: GZ8MTXP01AZY7M.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattacgtggtgggacgtccctggctggcacctgtactccgacgttggagtcgagggaactcgtggtccaccgtctcctcacgccctccaccgaacgggcccacgtccggtcccttcccccgtcggcccgcccctcgcctccgaggcgccacccgtccgacgacgccacgacggccggcccgtggggcctcggcccgtgggtaccaaacgggtaccttaccgttcccgtacttccgttcttcgctggaacggcgggcttcgggcgaaggccg

SEQ ID NO: 402717 - DNA, 571 bp, Homo sapiens
  misc_feature: GZ8MTXP01CIQNR.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaattgggtccgccaggctccgagggaagggctggagtgggtgccaacataaagccagatggaggtagtaaaaacagtatgtagactcgtgtggagggccggttcaccatctaccagagacaacgccaaagaatgcgatatatctacagatagaacagctgccgagcgaggacacggctgtgtattacgtggtgggacgtccctggctggcactgtactccgacgttggacgtcgacgggactcgtggtcaccgtcgtcctctacgccctccgacccgaacgggccccacgtcccggtccttccccccgtggcccgtcccctcggcctccgacggacgccacccgccgaacgcggacaacgcgccggcccgtcgggccgtccgg

SEQ ID NO: 402718 - DNA, 602 bp, Homo sapiens
  misc_feature: GZ8MTXP01DFK2T.11.13.B02.1.454.CMB.2.raw
  modified_base (237)..(237): a, c, t, g, unknown or other
tcagcgagagataccacgaccggtgctcgatttagtctagcgactttgggttctccttgttgctattttagaaggtgtccagtgtgaggcgcagatggtggggtcgtgggggaggcttggtccagcctggggggtccctgagactctcctgtacagcctctggattcagcatcagttcgtattggatgaattgggtccgccaggctccgaggggaagggctggagtgggtggccaanataaagccagatggaggtagtaaaacagtatgtagactctgtggagggacggttcaccatctccagagacaacgccaaagaatgcgatatatctacagatgaacagctgccgagcgagacacggctgtgtattacgtggtgggactcccgtgggctggcaacctgtacgtccgtacggttggagtcgaggggaactcgtggtcacccgtctccctcgacgcctcccgaccaacggggcccctaacttccgggttcccctttcccccgcgggtcccgcccccgttgccccgtccgacggggaacccgcccgacccgttccggaacggaacgacccgaacgccgggcccgggcccgtcgggccgtcg

SEQ ID NO: 402719 - DNA, 684 bp, Homo sapiens
  misc_feature: GZ8MTXP01C1IUB.11.13.B02.1.454.CMB.2.raw
  modified_base (235)..(235): a, c, t, g, unknown or other
  modified_base (259)..(259): a, c, t, g, unknown or other
  modified_base (373)..(373): a, c, t, g, unknown or other
  modified_base (537)..(537): a, c, t, g, unknown or other
tcagcgagagataccacgaccggtgctcgatttagtctagcgactttgggttctccttgttgctattttagaaggtgtccaatgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtgccaanataaagccagatggagtgtaaaangtatgtagactctggtggagggccgttcaccatctccagagacaacgacaaagaatgacgatatatctaacagatgaacagctgccgagccgaggacacggctgtgtattacgnggtgggactcccgtggctggcacctgtactccggtaccggttaggacgttcgaaggggtaaccttcgtcgggttaccacccggttccgtcccttccgaacgtcccctacccgaaacccgaaacggggtccccaacgttccccggggttccccttttccccccgnggggtccccgtcccccggttcggcccctttacccccgaaagggggtaccctaccccggacccccgttcccgggaacgggtaaaccgggacccaaccggtaaccgggccccggggttccccccgggtgggggttccccgttcccgggg

SEQ ID NO: 402720 - DNA, 564 bp, Homo sapiens
  misc_feature: GZ8MTXP01ELWIA.11.13.B02.1.454.CMB.2.raw
  modified_base (301)..(301): a, c, t, g, unknown or other
tcagcgagagataccacgaccggtgctcgatttagtctagcgactttgggtctgggggaggcttggtccagcctgggggtccctgagactctcctgtacagcctctggattcagcatcagttcgtattggatgaattgggtccgccaggctccagggaagggctggagtgggtgccaacataaagccagatggaggtagtaaaacagtatgtagactctgtggagggccgttcaccatctccagagacaacgcaagaatgcgatatatcacagatgaacagcctgcgagccgagacacggntgtgtatacgtgtgggagtccctggctggcacctgtatccgacgttggagtcagggaactcgtgtacctaccgtctctcacgccctacaccgacggcctacgtccgttccccttccccgtcgcccgccgtcgccgtacgacggacgcctacccgtaccgagacgccacgacggccggcccgtgggtcctcgtccggtcggtaacgaacggtccttaccgttcgtacttcgttcgccgtgtaggcggcggtcgcggcgaacggc

SEQ ID NO: 402721 - DNA, 569 bp, Homo sapiens
  misc_feature: GZ8MTXP01EBAFR.11.13.B02.1.454.CMB.2.raw
  modified_base (388)..(388): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaagggctggagtgggtggccaacataaagccagatggaggtgtaaaacagtatgtagactctggtggagggccggttcaccatctccagagacaacgccaaagaatgcgatatatctacagatgaacagcctgccgagcgaggacacggctgtgtattacgtggtgggactcccgnggctggcactgtactccgacgttggagtcgagggaactcgtgtccaccgttctcccttcacgccctaccaacccgaacggggcccacgttcccggttcccttcccccgtcggccctccctcgcctcccgaggacgccacccgttccgacgaacgcaacgcggccggcccgtcgggcgtcgg

SEQ ID NO: 402722 - DNA, 603 bp, Homo sapiens
  misc_feature: GZ8MTXP01CHG9B.11.13.B02.1.454.CMB.2.raw
  modified_base (200)..(200): a, c, t, g, unknown or other
  modified_base (236)..(236): a, c, t, g, unknown or other
  modified_base (261)..(261): a, c, t, g, unknown or other
  modified_base (295)..(295): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagccgtggggggtccctgagactctcctgtacagcctctggattcagcatcagttcgtattggatgaattgggtccnccaggctccgagggaagggctggagtgggtgccaanataaagccagatggagtgtaaaacngtatgtagactctgtggagggccgttcaccatcncagagacaacgccaaagaatgacgatatatctacagatgaacagcctgccgagcgaggacacggctgtgtattacgtggtggggactccccgtggctggcctaccgtgtacgtcccggaccgtttggaggtcgaacggggaactcgtggtccaccgtcctacctcacgccctacccgaacccgaaacgggcccctaagttcccgtcccgttccccccgtcggggtcccccgcccgtcgccgtacccgacggaccgtcccacccgcgacgaacgaccgaaccgacggtcccgggccgtcgggccgtcgg

SEQ ID NO: 402723 - DNA, 633 bp, Homo sapiens
  misc_feature: GZ8MTXP01C00Z4.11.13.B02.1.454.CMB.2.raw
  modified_base (581)..(581): a, c, t, g, unknown or other
tcagcgagagataccacgaccggtgctcgatttagtctagcgactttgggttctccttgttgctattttagaaggtgtccagtgtgaggcgcagatgggtgggggtcgtggggggaggcttggtccagccgtggggggtccctgagactctcctgtacagcctctggattcagcatcagttcgtattggatgaattgggtccgccaggctccgaggggaagggctggagtgggtgcaacataaagccagatggaggtagtaaaacagtatgtagactctggtggagggccggttcaccatcctaccagacgaacaacgaccaaagaatgacgatatatctaacagatagaaacagcctgaccgacggacgaggaccacggcttgtgttattacgtgggtgggacgtcccgtgggctggctaccgtgtacgtccggtaccggttgggacgtcgaacggggtaactcgtacgggtcctacccggttctccctcgaccgcccctacccgaacccggaacgggcccctacggttcccggttccccttcccccggtcggccccgtcccctcgcctccgagggaccnccgttacccgcggacgcgaccgaacgcggcccgggcccgtgggccgtccggg

SEQ ID NO: 402724 - DNA, 611 bp, Homo sapiens
  misc_feature: GZ8MTXP01AV2LP.11.13.B02.1.454.CMB.2.raw
  modified_base (392)..(392): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctgggagtgggtggccaacataaagccagatggaggtagtaaaacagtatgtagactctggtggagggccggttcaccatctccagagacaacgccaaagaatgcgatatatctacagatgaacagcctgccgagcgaggacacggctgtgtattacgtggtgggacgtcccgnggctggctacctgtactcccggtacgttgggactcgacgggtaactcgtcgggtaccacccgttcgtcctcgacgtcccctaccgaacccgaacgggcccctacgttcccggttccccttcccccgtgggcccgtccccttcggcccgtacccgagggaccgcccacccgttccggagaaccgccaaccgcggcccgggttcccgtgggggcctccggg

SEQ ID NO: 402725 - DNA, 561 bp, Homo sapiens
  misc_feature: GZ8MTXP01A0MSV.11.13.B02.1.454.CMB.2.raw
  modified_base (269)..(269): a, c, t, g, unknown or other
  modified_base (502)..(502): a, c, t, g, unknown or other
  modified_base (535)..(535): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaattgggtccgcccaggctccgaggggaaggggctgggagtgggtggccaacataaagccagatggaggtagtaaaacngtatgtagactctggtggagggccggttcaccatctccagagacaacgccaaagaatgcgatatatctacagatgaacagcctgccgagcgaggacacggctgtgtattacgtggtgggacgtcccgtgggctggcaccgtgtactccggacgttggagtcgagggactcgtggtccaccgtctcctcacgcctccacccgaagggcccagtccggtcctcccccgtggcccnccctgcctccgaggacgccacccgttcgacgcncaacgcggccggccctggggcctcgg

SEQ ID NO: 402726 - DNA, 575 bp, Homo sapiens
  misc_feature: GZ8MTXP01DFQPY.11.13.B02.1.454.CMB.2.raw
  modified_base (506)..(506): a, c, t, g, unknown or other
  modified_base (544)..(544): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagccgtggggggtccctgagactctcctgtacagcctctggattcagcatcagttcgtattggatgaattgggtccgccagcctccgaggggaaggggctgggagtgggtgccaacataaagccagatggaggtagtaaaacagtatgtagactctgtggagggccggttcaccatctccagagacaacgccaaagaatgcgatatatctacagatgaacagcctgccgagccgaggacacggctgtgtattacgtgggtggggacgtcccgtgggtctgggccaccgtgtacgtccggtaccggttgggacgtcgagggaactcgtggtctaccgtctcctcacgccctaccaccacgggcccacgtccgtcccttccccgnggcccgcctcgcctccgaggacgccacccgttcgacgngccgaacacggccggcccgtcgggctccggg

SEQ ID NO: 402727 - DNA, 548 bp, Homo sapiens
  misc_feature: GZ8MTXP01A1MHV.11.13.B02.1.454.CMB.2.raw
  modified_base (265)..(265): a, c, t, g, unknown or other
  modified_base (513)..(513): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtgtaaaacngtatgtagactctgtggagggccggttcaccatctccagagacaacgccaaagaatgcgatatatctacagatgaacagcctgccgagccgaggacacggctggtgtattacgtggtgggagtccctgggctgggcaccgtgtactccgacgttggagtcgagggaactcgtggtcaccgtctcctcacgccctccaccgaacgggcccacgtccggtccttcccctggccgccctgctccgagcgcncccgttccgagngcncgngtccgccgtgggctcgg

SEQ ID NO: 402728 - DNA, 741 bp, Homo sapiens
  misc_feature: GZ8MTXP01ELUS9.11.13.B02.1.454.CMB.2.raw
  modified_base (258)..(258): a, c, t, g, unknown or other
  modified_base (266)..(266): a, c, t, g, unknown or other
  modified_base (274)..(274): a, c, t, g, unknown or other
  modified_base (299)..(299): a, c, t, g, unknown or other
  modified_base (337)..(337): a, c, t, g, unknown or other
tcagcgagagataccacgaccggtgctcgatttagtctagcgactttgggttctccttgttgctattttagaaggtgtccagtgtgaggcgcagatgggtggggtcgtggggggaggcttggtccagccgtggggggtccctgagactctcctgtacagcctctggattcagcatcagttcgtattggatgaagttggtccgcaggctcgaggggagggctgggagtgggtgcaacataaagcagatggagtataaangtatgtanactctggnggacgggccgtcaccatctacaganacaacgacaaagatgacatatatactacagatagaacngcctgaccgacggcggaaggacacgggtacttagtgttaatttacgtgggttacggggtacggttccccgtgggtccgttcggaccctaaccgttacggttaaccgttccccgggtaacccgggttttaggggaacggtttaccgggaaacgggggttaacccttcgtccggggttaccctaacccgggttccttacccgttaccgaccgtaccccctaccgaaaccccgggaaccgggcccccttaggttcccccggttccctttcccccggtcgggccccggtccccctgggccccttacccgggaaggggaccctacccgttaaccccggttcgggaacgaaccggcccgaaccgtccggggcccccggggttaccccgttcggggttcccgttcccgggg

SEQ ID NO: 402729 - DNA, 546 bp, Homo sapiens
  misc_feature: GZ8MTXP01BA7XQ.11.13.B02.1.454.CMB.2.raw
  modified_base (389)..(389): a, c, t, g, unknown or other
  modified_base (490)..(490): a, c, t, g, unknown or other
  modified_base (495)..(495): a, c, t, g, unknown or other
  modified_base (511)..(511): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctgggggggtccctgagactctcctgtacagcctctggattcagcatcagttcgtattggatgaattgggtccgccaggctccgagggagggctggagtgggtgccaacataaagccagatggaggtagtaaaacagtatgtagactctggtggagggccggttcaccatctccagagacaacgccaaagaatgcgatatatctacagatgaaacagcctgccgagcgaggacacggctgtgtattacgtgtggggactcccnggcctggcacctgtatccgaccgttggagtcgaggggaactcgtcgggtcacccgtctccctcacgccctccacccgaagggcccatcggtccttccccgnggccnccctgctccgaggccnccacgccgacgcgcaacgcggccgccgtcggctcg

SEQ ID NO: 402730 - DNA, 585 bp, Homo sapiens
  misc_feature: GZ8MTXP01CKJDU.11.13.B02.1.454.CMB.2.raw
  modified_base (266)..(266): a, c, t, g, unknown or other
  modified_base (465)..(465): a, c, t, g, unknown or other
  modified_base (507)..(507): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatgggaggtagtaaaacngtatgtagactctggtggagggccggttcaccatctccagagacaacgccaaagaatgcgatatatctaacagatgaacagcctgccgagcgaggacacggcttgtgtattacgtggtgggacgtccctgggcgtggcaccgtgtacgtccggacggttggacggtacgagggtaactcgtggtctacccgtctcctcncgccctccaccgaacgggcccacgtccggtcccttcccccgnggcccgcccgtcgccgtccgacgggtacgcccacccgttcggacgaacgccaacgcggccggcccgtcggggcctcgg

SEQ ID NO: 402731 - DNA, 566 bp, Homo sapiens
  misc_feature: GZ8MTXP01C0B8V.11.13.B02.1.454.CMB.2.raw
  modified_base (277)..(277): a, c, t, g, unknown or other
  modified_base (382)..(382): a, c, t, g, unknown or other
  modified_base (402)..(402): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaattgggtccgccaggctcgaggggaaggggctgggagtgggtgcaacataaagccagatgggaggtagaaaacagtatgtagactntggtggagggccggttcacatctcagagacaacgccaaagatgacgatatatctaacagatagaacagcctaggcccgaggccgaggacacggctgtgtattcgnggtgggacgtcctggctgcnctgtactccgtacggttggacgtcgacgggaactcgtggtccaccgtctcctcacgccctaccaccgaacggcctacgtccggtcccttccccgcggcccgccctcgcctccgaggacgccacccgttcggacgcgacaacgcggccggcccgtcgggcctcgg

SEQ ID NO: 402732 - DNA, 595 bp, Homo sapiens
  misc_feature: GZ8MTXP01CGCK7.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacagtatgtagactctggtggagggccgttcaccatctccagagacaacgcaaagaatgcgatatatctacagatgaacagcctgcgagccgaggacacggctgtgtattactggtgggagtcccgtggctggcacctgtactccgtacgttggagtcagggaactcgtgggtccaccgtctcctcacgccctccaccgaacgggcccacgtccggtccttcccccgtggcccgccccttcgcctccgacggacggccacccgtccgacgacgccacgacggcccggcccgtcggggcctcggcccgtcgggtacgaaacgggtccttacgtttcccgtacttccgttcttccggtctggcggccgggcgttcgggaacgaacggccg

SEQ ID NO: 402733 - DNA, 558 bp, Homo sapiens
  misc_feature: GZ8MTXP01A2RT3.11.13.B02.1.454.CMB.2.raw
  modified_base (381)..(381): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaattgggtccgccaggctccaggggaaggggctgggagtgggtggccaacataaagccagatgggaggtgtaaaacagtatgtagactctgtggagggccggttcaccatctccagagacaacgccaagaatgcgatatatctacagatgaacagcctgccgagcgaggacacggctgtgtatacgtgtgggngtccctggctggcacctgtactccgacgttggacgttcgagggactcgtggtcaccgtctcctcacgcctccaccgacgggcccagtccggtcccttccccgtcggcccgcccgtgcctccgaggacgccacccgttccgagcgccaacgtacggccggttcccgtcgggcgtccgg

SEQ ID NO: 402734 - DNA, 559 bp, Homo sapiens
  misc_feature: GZ8MTXP01BKD08.11.13.B02.1.454.CMB.2.raw
  modified_base (237)..(237): a, c, t, g, unknown or other
  modified_base (262)..(262): a, c, t, g, unknown or other
  modified_base (504)..(504): a, c, t, g, unknown or other
  modified_base (520)..(520): a, c, t, g, unknown or other
  modified_base (534)..(534): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaagggctggagtgggtgccaanataaagccagatggagtataaaacngtatgtagactctggtggacgggccgttcaccatctccagagacaacgccaaagaatgacgatatatctaacagatagaacagcctgccgagcgagacacggctgtgtattacgtggtcgggacgtcccgtgggctggctactgtactccgacggttggagtcgagggacctcgtcggtaccacccgtctcctcgacgccctaccaccgaacggccctacgtccgtccctccccgtggcccnccctgcctcgacggcnccaccgttcgagcnccaacgcggccggccgtgggctcgg

SEQ ID NO: 402735 - DNA, 569 bp, Homo sapiens
  misc_feature: GZ8MTXP01DQKDW.11.13.B02.1.454.CMB.2.raw
  modified_base (290)..(290): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattggtccgccaggctccgaggggaaggggctggagtgggtgccaacataaagccagatggaggtagtaaaacagtatgtagactctgtggagggccggttnaccatctccagagacaacgcaaagatgcgatatatctacagatgaacagctgccgagcgaggacacggctgtgtattacgtggtgggagtccctggctggcactgtactccgaccgttggagtcgagggactcgtggtcaccgtctcctcacgccctaccaccgaacgggcccacgtccggtcccttcccccgtgggcccgtccccgtcgcctccgacgggacgccgaacccgttccgaacgcgccaacgacggcccggccccgttgggccgttccggg

SEQ ID NO: 402736 - DNA, 552 bp, Homo sapiens
  misc_feature: GZ8MTXP01E49Q0.11.13.B02.1.454.CMB.2.raw
  modified_base (265)..(265): a, c, t, g, unknown or other
  modified_base (509)..(509): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaattgggtccgccaggctccgaggggaagggctggagtgggtgccaacataaagccagatggaggtagtaaaacngtatgtagactctgtggagggccggttcaccatctccagagacaacgccaaagaatgcgatatatctacagatgaacagcctgccgagccgaggacacggctgtgtattactgtggggatccctggctggcacctgtatccgaccgttggagtcgaagggaactctggtcaccgtctcctcacgccctccaccgaacgggcccatccggtccttcccccgtggccgcccctgcctccgaggacnccacccgttccgagaacgcaacacggccggccctcgggctcgg

SEQ ID NO: 402737 - DNA, 551 bp, Homo sapiens
  misc_feature: GZ8MTXP01DD7CU.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtggccaacataaagccagatggaggtgtaaaacagtatgtagactctgtggagggccgttcaccatctccagagacaacgccaaagaatgcgatatatctacagatgaacagcctgccgagcgaggacacggctgtgtattacgtggtgggacgtccctgggctgggctacctgtactccggaccgttgggagtcgagggactctggtcaccgtctcctcacgccctccacccaagggcccagtccggtccttcccctggcccgccctgcctccgaggacgccaccgttccgagcgcaacgtacggccggccctgggcctcgg

SEQ ID NO: 402738 - DNA, 576 bp, Homo sapiens
  misc_feature: GZ8MTXP01C891R.11.13.B02.1.454.CMB.2.raw
  modified_base (537)..(537): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggcaacataaagccagatgggaggtagtaaaacagtatgtagactcgtggtggagggccggttcaccatctccagagacaacgccaaagaatgcgatatatctacagatgaacagcctgccgagccgagacacggctgtgtattacgtggtggggactcccgtgggctggcacctgtactccggtaccgttggacgttcgaggggaactcgtggtccaccggttctccctcgacgtccctacccaaccgaacgggccctacgttcccggtcccttcccccgtcggcccgtcccctgcctccgaggacnccaccgttccgagcgcaacgcggccggccgtcgggctcg

SEQ ID NO: 402739 - DNA, 562 bp, Homo sapiens
  misc_feature: GZ8MTXP01AF6EK.11.13.B02.1.454.CMB.2.raw
  modified_base (238)..(238): a, c, t, g, unknown or other
  modified_base (266)..(266): a, c, t, g, unknown or other
  modified_base (495)..(495): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctggggggtccctgagactctcctgtacagcctctggattcagcatcagttcgtattggatgaattgggtccgccaggctccgaggggaagggctgggagtgggtgccaanataaagccagatgggaggtagtaaaacngtatgtagactctggtggagggccggttcaccatctccagagacaacgccaaagatgcgatatatctacagatgaacagcctgccgagcgaggacacggctgtgtattacgtggtggggacgtcccgtgggctggcaccgtgtactccggacgttggagtcgagggactcgtggtcaccgtctcctcacgccctccaccgacgggcccacgtccggtcccttcccccgnggcccgccctcgcctccgacggacgccaccgttccggagcgcaacgcgccggcccgtgggcctccgg

SEQ ID NO: 402740 - DNA, 541 bp, Homo sapiens
  misc_feature: GZ8MTXP01EO9LS.11.13.B02.1.454.CMB.2.raw
  modified_base (367)..(367): a, c, t, g, unknown or other
  modified_base (383)..(383): a, c, t, g, unknown or other
  modified_base (452)..(452): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacagtatgtagactctggtggagggccggttcaccatctccagagacaacgccaagaatgcgatatatctacagatgaacagcctgcgagccgaggacacggctgtgtattacgtggtgggatccctggctggcacctgactcgacgttgagtcagggaactntggtcaccgtctcctnacgcctcaccaagggcccatcggtcctccccgtgccgcctgctccgaggacgcacctccgagagcaacngccgccctgggctcgaccgtggtcaaagggtccttaacgttcccgtaattccgttccttcgccggtggcggcggcgcggtcgaacggcg

SEQ ID NO: 402741 - DNA, 578 bp, Homo sapiens
  misc_feature: GZ8MTXP01BXVKA.11.13.B02.1.454.CMB.2.raw
  modified_base (259)..(259): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaagggctggagtgggtgccaacataaagccagatggagtgtaaaacngtatgtagactctggtggagggccggttcaccatctccagagacaacgccaaagaatgcgatatatctacagatgaacagcctgccgagccgaggacacggctgtgtatttacgtggtggggacgtcccgtgggctgggcaccgtgtactccgaccggttggacgtcgagggaactcgtcggtcaccgtcgtcctcacgcctccaccgaacgggcccacgtcccggtcccttcccccgtcggcccgccccgtcgccgtcccgaggacgccacccgttccgacgaacgccaacgcggccgggttccccgtgggccgtcgg

SEQ ID NO: 402742 - DNA, 594 bp, Homo sapiens
  misc_feature: GZ8MTXP01BTI2H.11.13.B02.1.454.CMB.2.raw
  modified_base (264)..(264): a, c, t, g, unknown or other
  modified_base (392)..(392): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgagggaagggctggagtgggtgccaacataaagccagatggaggtagtaaaacngtatgtagactcgtggtggagggccgttcaccatctccagagacaacgccaagaatgcgatatatctacagatagaacagcctgccgagcgaggacacggctgtgtattacgtggtgggacgtcccgnggctggctaccgtgtacgtcccgacggttggagttcgagggaactcgtggtccaccgtctcctcacgccctaccaccgacgggccctacgttccggtccccttcccccgcggcccgtccccgtcgttccctacccggaaggaccgccaccccgttccgacggaacgccaaccgtaccggcccgggcccgtcgggcgtcccgg

SEQ ID NO: 402743 - DNA, 537 bp, Homo sapiens
  misc_feature: GZ8MTXP01D3BB6.11.13.B02.1.454.CMB.2.raw
  modified_base (198)..(198): a, c, t, g, unknown or other
  modified_base (236)..(236): a, c, t, g, unknown or other
  modified_base (262)..(262): a, c, t, g, unknown or other
  modified_base (520)..(520): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccnccaggctccgaggggaagggctgggagtgggtgccaanataaagccagatggaggtgtaaaacngtatgtagactctggtggagggccggttcaccatctccagagacaacgccaaagaatgcatatatctacagatgaacagcctgccgagccgagacacggctgtgtattacgtggtgggactccctgggctggcacctgtactccgacgttggagtcgagggactcgtggtcaccgttctcctcacgcctccaccgacggcccagtccgtcctccccgtggccgccctgcctccgaggacgcaccgttcgagcgcaacncgccggccgtggctcgg

SEQ ID NO: 402744 - DNA, 576 bp, Homo sapiens
  misc_feature: GZ8MTXP01DZDAT.11.13.B02.1.454.CMB.2.raw
  modified_base (340)..(340): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgcaggctccgagggagggctggagtgggtgccaacataaagccagatggaggtagtaaaacagtatgtagactctggtggagggcccggttcaccatctccagagacaacgccaaagatgcatatatctacagatgaacngcctgccgagcgaggacacggctgtgtatacgtggtgggactcccgtggctggcactgtactccgaccgttggacgtcgagggaactcgtggtccacccgttcgtccctcacgcccctccgaacccgaacgggtccccagttcccggttccccttcccccgtggcccgcccctcgcctacccgaggacgcccacccgttccgacgaacgccaacgcggccggcccctggggctcgg

SEQ ID NO: 402745 - DNA, 562 bp, Homo sapiens
  misc_feature: GZ8MTXP01C741V.11.13.B02.1.454.CMB.2.raw
  modified_base (496)..(496): a, c, t, g, unknown or other
  modified_base (534)..(534): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactctggtggagggccggttcaccatctccagagacaacgccaaagaatgcatatatctacagatgaacagcctgccgagaccgaggacacggctgtgtattacgtgtgggacgtccctgggctggcaccgtgtactccgaccgttggagtcgagggactcgtggtcaccgtctcctcgacgccctaccaccgaacgggcccacgtcccggtccttcccccnggccgccctgcctccgaggacgccacccgttccgagcncaacgacggccggcccgtcgggctccgg

SEQ ID NO: 402746 - DNA, 586 bp, Homo sapiens
  misc_feature: GZ8MTXP01B1NFI.11.13.B02.1.454.CMB.2.raw
  modified_base (300)..(300): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagccgtggggggtccctgagactctcctgtacagcctctggattcagcatcagttcgtattggatgaattgggtccgccaggctccgaggggaagggctggagtgggtggccaacataaagtcagatggaggtagtaaaacagtatgtagactctggtggagggccgttcaccatcnccagagacaacgccaaagatgcgatatatctacagatggacagcctgccgagcgaggacacggctgtgtattacgtgggtgggacgtcccgtgggcctggctaccgtgtactccgtacggttggagtcgagggacttcgtcggtcctaccgtctcctcgacgccctaccaccgaacggccctacgtcccggttcccttccccgtcggcccgtccctcgccgtacccgcggacgcccacccgttccgacgaacgccaacgcggcccgggcccgtcggggcctccggg

SEQ ID NO: 402747 - DNA, 633 bp, Homo sapiens
  misc_feature: GZ8MTXP01DVKQE.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacagtatgtagactctggtggagggccgttcaccatctccagagacaacgcaaagatgcgatatatctacagatgaacagcctgcgagccgagacacggctgtgtattacgtggtgggacgtcccgtggcctggcctaccgttgtactccggtaccgttggacgtacgagggtaactcgtcggtccaccgtcctcctcacgccctaccgaaccgaacgggccctagttcccggttcccttcccccgtggccccgtccctcgcctaccgaacgggacggaccctaccgtaccggaagacgccgacgtacggcccgggtcccgtggggtccttcggccgtaacgggtaaccgaacgggtaccctttaccgttccgtattccgttccgttcggccgtagggcggtcgggcttacgggaacgaacgggtc

SEQ ID NO: 402748 - DNA, 569 bp, Homo sapiens
  misc_feature: GZ8MTXP01EG6R1.11.13.B02.1.454.CMB.2.raw
  modified_base (260)..(260): a, c, t, g, unknown or other
  modified_base (293)..(293): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccaacctggggggtccctgagactctcctgtacagcctctggattcagcatcagttcgtattggatgaattgggtccgccaggctccgagggaaggggctggagtgggtgccaacataaagccagatggagtgtaaaacngtatgtagactctgtggagggccgtcaccatcnccagagacaaagccaaagaatgcgatatatctacagatgaacagcctgcgacgccggaggacacggctgtgtaattacgtggtggggacgtcccgtgggctggctaccgtgtactccgacgttggacgtcgagggactcgtgtcaccgtctcctcacgccctaccaccgaacgggcccagtccggtcccttcccccgtggcccgccctgcccttccgaggcgccacccgttccggagacgccacgcggcccggcccgttggggtccttcggtcccg

SEQ ID NO: 402749 - DNA, 548 bp, Homo sapiens
  misc_feature: GZ8MTXP01DDAX2.11.13.B02.1.454.CMB.2.raw
  modified_base (528)..(528): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaattgggtccgccaggctccgagggaagggctggagtgggtgcaacataaagccagatggaggtagaaaacagtatgtagactctgtggagggccgttcaccatctccagagacaacgccaaagaatgcgatatatctaacagatgaacagcctgccgagcgaggacaggctgtgtattacgtggtgggacgtccctggctggcacctgtactccgtaccgttggacgtcgagggaactcgtggtcaccgtctcctcacgcctaccaccgacggcccacgtccgtccttcccccgcggccgccctcgcctccaggacgccaccgttccgagaacgcaacncggccggcccgtgggctcgg

SEQ ID NO: 402750 - DNA, 562 bp, Homo sapiens
  misc_feature: GZ8MTXP01BWFUN.11.13.B02.1.454.CMB.2.raw
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctggagtgggtgccaacataaagccagatggaggtagtaaaacagtatgtagactctggtggagggccggttcaccatctccagacgacaacgccaagaatgcgatatatctacagatagaacagctgccgagcgaggacacggctgtgttattcgtgggtcggggtacgtcccgtgggctcggctaccgtgtacgtccggtacggttggagtcgagggactctcgtcctaccgtctcctcacgccctaccgaccaccggccacgtccgtcctccccgtcggcctccctcgcctccgcgacgcaccgttcgacgcgcaacgcgccggccgtcggcgtccgg

SEQ ID NO: 402751 - DNA, 583 bp, Homo sapiens
  misc_feature: GZ8MTXP01A6P9C.11.13.B02.1.454.CMB.2.raw
  modified_base (265)..(265): a, c, t, g, unknown or other
  modified_base (370)..(370): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccaaccgtggggggtccctgagactctcctgtacagcctctggattcagcatcagttcgtattggatgaattgggtccgccaggctccgagggaaggggctggagtgggtggccaacataaagccagatggaggtagtaaaacngtatgtagactctgtggaggccgtcaccatctccagagacaaagccaaagaatgcgatatatctacagatgaacagcctgcgacgccggaggacacggctgtgtnttacgtggtgggacgtccctgggctgcactgtactccgacgttggagtcgagggaactcgtcggtccaccgttcctcctcgaacgccctacccgaacccgaacgggccccaagttcccgggttcccttccccccgtggcccgccccgtgccttccgacggacgccacccgttccgagacgccacgaacgccggcccgttgggccttcggcccg

SEQ ID NO: 402752 - DNA, 568 bp, Homo sapiens
  misc_feature: GZ8MTXP01CSO50.11.13.B02.1.454.CMB.2.raw
  modified_base (458)..(458): a, c, t, g, unknown or other
  modified_base (541)..(541): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctgggagtgggtggccaacataaagccagatggaggtagtaaaacagtatgtagactctgtggagggccggttcaccatctccagagacaacgccaaagaatgcgatatatctaacagatgaacagcctgccgagccgaggacacggctgtgtattacgtggtgggacgtccctggccttgggcaccgtgtacgtcccgaccggttggagtcgaggggaactcgtggtcaccgtctcctcncgcctccaccgaacggcccatccggtccttcccccgtggcccgcccctgccgtcccgaggacgccgacccgttccgacgaacnccaacgacgccggcccgtgggctccgg

SEQ ID NO: 402753 - DNA, 559 bp, Homo sapiens
  misc_feature: GZ8MTXP01DBS5C.11.13.B02.1.454.CMB.2.raw
  modified_base (497)..(497): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaattgggtccgccaggctccgagggaagggctggagtgggtggccaacataaagccagatggaggtagtaaaacagtatgtagactctgtggagggccgttcaccatctccagagacaacgccaaagaatgcgatatatctaacagatgaacagcctgccgagccgaggacacggctgtgtattacgtggtgggacgtccctggctggcacctgtactccgaccgttggagtcgagggaactcgtggtcaccgtctccctcacgccctccaaccgaacgggcccagtccggtcccttccccgtggcccnccctgcctccgaggacgccacccgttccgagaacgcaacgcggccggcccgtggggcctcgg

SEQ ID NO: 402754 - DNA, 567 bp, Homo sapiens
  misc_feature: GZ8MTXP01BQCAW.11.13.B02.1.454.CMB.2.raw
  modified_base (263)..(263): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggaggtgtaaaacngtatgtagactctggtggagggccggttcaccatctccagagacaacgccaagaatgcgatatatctacagatgaacagcctgccgagcgaggacacggctgtgtattacgtggtgggagtccccgtgggcctggcaccgtgtactccgacgttgggagtcgagggactcgtggtcaccgtctcctcacgccctccacccgacgggcccacgtccggtccttcccccgtcggccgcccctgcctccgacggacgccacccgttccgacgaacgccgaacgcggccgggcccctggggccgtcgg

SEQ ID NO: 402755 - DNA, 597 bp, Homo sapiens
  misc_feature: GZ8MTXP01C7IFE.11.13.B02.1.454.CMB.2.raw
  modified_base (442)..(442): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgcgagccgaggacacggctgtgttattacgtggtgggacgtcccgtggctggcaccgtcgtactccgacgttggagtcgaagggaactcgtcggtccaccgtctcctcacgccctaccaccgaacgggcccagttcccggtccttcccccgnggcccgccctcgcctaccgacggcgcccaccgtccgagacgcaccgacggcccgcccgtgggcctcggcccgttaacgggtacaaacgggtaccttacgtttacccgtattcccgttcttccgcgtaggcgggtcgggcttcgggcgaacggccg

SEQ ID NO: 402756 - DNA, 516 bp, Homo sapiens
  misc_feature: GZ8MTXP01DPKK9.11.13.B02.1.454.CMB.2.raw
  modified_base (498)..(498): a, c, t, g, unknown or other
  modified_base (501)..(501): a, c, t, g, unknown or other
  modified_base (507)..(507): a, c, t, g, unknown or other
tcagcgagagataccacgaccggtgctcgatttagtctagcgactttgggtctgggggaggcttggtccagcctgggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccggttcaccatctccagagacaacgccaagaatgcgatatatctacagatgaaacagcctgcgagcccgaggacacggctgtgtattactgtgggagtccctggctggcacctgtatcgacgttggagtcagggaactcgtgggtcacccgtctctcacgcctccaccaggcccatccgtcttcccctgccgcctgctcaggacgcacctcgagagcacagccggccctgggcctgcctggtcaggcttacgtccgtattcgttcttcgntgngcggcnggcaaggcg

SEQ ID NO: 402757 - DNA, 572 bp, Homo sapiens
  misc_feature: GZ8MTXP01AYTYJ.11.13.B02.1.454.CMB.2.raw
  modified_base (271)..(271): a, c, t, g, unknown or other
  modified_base (465)..(465): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaaggggctgggagtgggtggccaacataaagccagatgggaaggtagtaaaacngtatgtagactctggtggagggccggttcaccatcctccagagaacaacgaccaagaatgacgatatatctacagatagaacagcctgccgaggcgaggacacggtctggtgtattacgtggtgggactccgtggctggcactgtactccggtcgttaggcgtcgagggactcgtcgtcaccgtctcctcgacnccctaccaccgaacggccctacgtccggtccctccccgtgccctcccgtcgcctccgacgacgccttacccgcggagccgcaacgcggcccggccgtgggccgtcgg

SEQ ID NO: 402758 - DNA, 606 bp, Homo sapiens
  misc_feature: GZ8MTXP01CS9EH.11.13.B02.1.454.CMB.2.raw
  modified_base (305)..(305): a, c, t, g, unknown or other
  modified_base (384)..(384): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaattgggtccgccaggctccgaggggaagggctgggagtgggtggccaacataaagccagatgggaggtagtaaaacagtatgtagactcgtggtggagggccggttcaccatcnccagagacaacgccaaagaatgcgatatatctaacagatgaacagcctgccgagcgaggacacggctgtgtatttacgngggtcgggacgtcccgtgggcgtggcaccgtgtacgtccggtaccggttgggacgtcgaacgggactcgtcggtcctaccgtcgtcctcaccgccctaccaaccgaacgggcccacgtcccggtcccttcccccgtcggccccgtccctcgcccgtccgacggtaccgccacccgttccgacgaacgccgaaccgacggcccggcccgtcgggttccgtcgg

SEQ ID NO: 402759 - DNA, 582 bp, Homo sapiens
  misc_feature: GZ8MTXP01A41DT.11.13.B02.1.454.CMB.2.raw
  modified_base (234)..(234): a, c, t, g, unknown or other
  modified_base (259)..(259): a, c, t, g, unknown or other
  modified_base (336)..(336): a, c, t, g, unknown or other
  modified_base (384)..(384): a, c, t, g, unknown or other
  modified_base (543)..(543): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccctggggggtccctgagactctcctgtacagcctctggattcagcatcagttcgtattggatgaattgggtccgccaggctccgagggagggctggagtgggtgccaanataaagccagatggagtataaaacngtatgtagactctgtggagggccgttcaccatctccagagacaacgccaaagaatgcgatatatctacagatgaacngcctgccgagcgaggacacggctgtgtattacgtggtgggactcccgngggctggccaccgttgtacgtcccggacggtttgggactcgaaggtacttcgtcggtcctaccgtccgtcctacgaccgtcccctaccgaaccgaccggtccctacggttcccgtccccttccccggtggcccctccccgtgccctacggacgggaccnccttaccgcgagccgcaacgcggccgccgtggccgtccg

SEQ ID NO: 402760 - DNA, 621 bp, Homo sapiens
  misc_feature: GZ8MTXP01BH67P.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaattgggtccgccaggctccgaggggaaggggctgggagtgggtggaccaacataaagccagatgggaggtagtaaaacagtatgtagactcgtggtggacgggccggttacacctatctccgaagacgaacaacgaccaaagaatgacgatatatctacagatagaacagcctgccgagacgagacacggctgtgtattacgtggtgggacgtcccgtgggctggcacgttgtactccggacggttggagtcgagggtacctcgtcgggtacctacccggttctcccgtacgacctcccctacccgaacccgaacgggtcccctagttcccggttcccttcccccgtcggcccgtcccctgcccgtccgagggaccgcccacccgttcggacggcgccgcgacgggcccggccccgttggggcctccggg

SEQ ID NO: 402761 - DNA, 574 bp, Homo sapiens
  misc_feature: GZ8MTXP01BY8UY.11.13.B02.1.454.CMB.2.raw
  modified_base (261)..(261): a, c, t, g, unknown or other
  modified_base (341)..(341): a, c, t, g, unknown or other
  modified_base (513)..(513): a, c, t, g, unknown or other
  modified_base (554)..(554): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaagggctggagtgggtggccaacataaagccagatggaggtgtaaaacngtatgtagactcgtggtggagggccggttcaccatctccagagacaacgccaaagaatgcgatatatctacagatgaacngcctgccgagcgagacaggctgtgtattactggtcgggacgtcccgtgggcctggcctaccgtgtacgtcccgaccggttgggagtacgaggggaacctcgtggtaccaccggttcctccgtcacgccctaccaccgaacgggccctacgtccgtcccttccccgtggcccnccctcgctcccgacggtacgccaccgttccgagcgcaacgnggcccggccctgggcctcgg

SEQ ID NO: 402762 - DNA, 643 bp, Homo sapiens
  misc_feature: GZ8MTXP01A3UI0.11.13.B02.1.454.CMB.2.raw
  modified_base (264)..(264): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctgggggggtccctgagactctcctgtacagcctctggattcagcatcagttcgtattggatgaattgggtccgccaggctccgagggaaggggctggagtgggtgccaacataaagccagatgggaggtgtaaaacngtatgtagactctggtggagggccggttcaccatctccagagacaacgccaaagaatgcgataatatctacagatagaaacagcctgccgagccggagacacggctgtgttattacgtggtgggtacgtcccgtgggctgggcaccgttgtactccggtacggttggacgtacgagggtactcgtggtaccaccgtctcctcaccgcctaccaccgaacgggccccagttcccgtcccttcccccgtcgggcccgtccccgttacgcccgttacccggacgggaccgtacccgaaccccgttcccgggaacggaaccggacccgaacccggtaaccggggccccgggttaccccgggttcgggggcccgtttcccgggg

SEQ ID NO: 402763 - DNA, 633 bp, Homo sapiens
  misc_feature: GZ8MTXP01B2EC3.11.13.B02.1.454.CMB.2.raw
  modified_base (263)..(263): a, c, t, g, unknown or other
  modified_base (376)..(376): a, c, t, g, unknown or other
  modified_base (391)..(391): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaagggctggagtgggtgcaacataaagccagatggaggtagtaaaacngtatgtagactctggtggagggccggttcaccatctccagagacaacgccaaagaatgcgatatatctacagatagaacagctgccgagcgaggacacggctgtgtattacgnggtgggacgtcccgnggctggcacgtgtactccgacgttggacgtcgagggactcgtcggtcacccgttctccctcgacgcccctaccgaaccgaccggggcccctacgttcccggttccccgtttccccccgtcgggtccccgtccccgttcggcccgttacccggacgggaccgcccaccccgttcccgggaacggaaccggacccaaaccggccgggcccgggttccccggttcgggggttcccgttcccgggg

SEQ ID NO: 402764 - DNA, 578 bp, Homo sapiens
  misc_feature: GZ8MTXP01EYVMX.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacagtatgtagactctggtggagggcccggttcaccatctccagagacaacgccaaagaatgcgatatatctacagatgaacagcctgccgagcgaggacacggctgtgtattacgtgtggggacgtcccgtggctggcacctgtactccgacgttggagtcgaggggactcgtggtccaccgttcctccttcacgcccctaccgacccgaacgggccccagttcccggtcccttcccccgtcggcccgccctcgcctccgacggacgccacccgttccgagcgccaacgcggccgggcccgtcggggctcccggg

SEQ ID NO: 402765 - DNA, 555 bp, Homo sapiens
  misc_feature: GZ8MTXP01AP2TT.11.13.B02.1.454.CMB.2.raw
  modified_base (263)..(263): a, c, t, g, unknown or other
  modified_base (365)..(365): a, c, t, g, unknown or other
  modified_base (497)..(497): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtggccaacataaagccagatggaggtagtaaaacngtatgtagactctggtggagggccggttcaccatctccagagacaacgccaaagaatgcgatatatctacagatgaacagcctgccgagccgaggacacggntgtgtattacgtggtgggactcccgtggcctggcacctgtactcccgacgttggacgtcgagggaactcgtggtccaccgtctcctcacgccctccaccgaacggccctagtcccggtcctccccgtggccnccctgcctcgagacgccaccgttccgagaacgcaacgcggtcccggcctcgggctcgg

SEQ ID NO: 402766 - DNA, 626 bp, Homo sapiens
  misc_feature: GZ8MTXP01CPHR6.11.13.B02.1.454.CMB.2.raw
  modified_base (366)..(366): a, c, t, g, unknown or other
  modified_base (377)..(377): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtgccaacataaagccagatggaggtagtaaaacagtatgtagactctggtggagggccggttcaccatctccagagacaacgccaaagaatgacgatatatctacagatgaacagctgccgagcgagacacggctgtntattacgtggngggacgtcccgtggcgtgggcacccgtgtacgtcccgtaccggttagggacgttacgaagggaactcgtggtacctacccggtcttcccgtctacgcccctaccgaacccgaacggggtcccaacgtcccgggttcccttcccccggtcggcccggtcccctcgcccgtcccgaggggaaccccgtcccgacccgttcgaaccggaacgaccgtaaccgaccgggcccggttccggtccgggcgtccgg

SEQ ID NO: 402767 - DNA, 558 bp, Homo sapiens
  misc_feature: GZ8MTXP01DT34D.11.13.B02.1.454.CMB.2.raw
  modified_base (239)..(239): a, c, t, g, unknown or other
  modified_base (264)..(264): a, c, t, g, unknown or other
  modified_base (497)..(497): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtggggggtccctgagactctcctgtacagcctctggattcagcatcagttcgtattggatgaagttgggtccgccaggctcgaggggaagggctggagtgggtgccaaanataaagcagatgggagtataaaacngtatgtagactctggtggagggccgttcaccatctccagagaacaacgccaagaatgcgatatatctaacagactgaacagcctgccgagccgaggtacacggcttgtgttatacgtgtgggacgtccctgctgcactgtatccgtaccggttggacgtcgacgggtaactcgtaggctaccgtcgtcctcacgcctccaaccgacggcctacgtccgtcctccccgtggccnccctcgcctcgacggcgccaccgttccgacgaacgcaacgcggccgcccgtcgggcgtccg

SEQ ID NO: 402768 - DNA, 674 bp, Homo sapiens
  misc_feature: GZ8MTXP01C0QL0.11.13.B02.1.454.CMB.2.raw
tcagcgagagataccacgaccggtgctcgatttagtctagcgactttgggttctccttgttgctattttagaaggtgtccagtgtgaggcgcagatgggtggggtcgtggggggaggcttggtccagccgtgggggggtccctgagactctcctgtacagcctctggattcagcatcagttcgtattggatgaattgggtccgccaggctccgaggggaaggggctgggagtgggtggcaacataaagccagatgggaggtagtaaaacagtatagtagactcgtggtggacgggccggttcaccatctccaagacgaacaacgaccaaagaatgacgatatatctaacagatagaacacgcctggcccgacggaccggaaggaccgacggacttaggtgttaattacgtgggtacggggtacgtccccgtgggcgtcggacctaccgtgtacgtccgtacggtaggacgtacgagggaacttcgtcggtacctaccgttctccctacgaccgtcccctacccgaacccgaaccgggtcccctaacgttccccggttccccttcccccggcgggtccccgtccccgtcggcccgttcccgaacgggaccgcccgttaacccgttccggaacgaacgaccaacggaccggcccgggcccggtggggccgtccggg

SEQ ID NO: 402769 - DNA, 556 bp, Homo sapiens
  misc_feature: GZ8MTXP01EJVVW.11.13.B02.1.454.CMB.2.raw
  modified_base (200)..(200): a, c, t, g, unknown or other
  modified_base (260)..(260): a, c, t, g, unknown or other
  modified_base (372)..(372): a, c, t, g, unknown or other
  modified_base (448)..(448): a, c, t, g, unknown or other
  modified_base (523)..(523): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctggggggtccctgagactctcctgtacagcctctggattcagcatcagttcgtattggatgaattgggtccnccaggctcgagggagggctggagtgggtgcaacataaagccagatggaggtagtaaaacngtatgtagactcgtgtggagggccggttcaccatctcagagacaacgcaaagatgcatatatctacagatgaacagcctgccgagccgaggtacacggctagtgtattacgnggtgggactccctgggctggctacctgtactccggacgttggacgtcgaagggactcgtggtcaccgttctcctcncgcctccaccgaacgggcccattccgtccttccccgtggcccgccctcgcctccaggacgccacccgttccgganaacggccaacgcggccggcccctggggctccgg

SEQ ID NO: 402770 - DNA, 553 bp, Homo sapiens
  misc_feature: GZ8MTXP01DH6QX.11.13.B02.1.454.CMB.2.raw
  modified_base (232)..(232): a, c, t, g, unknown or other
  modified_base (258)..(258): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtacagcctggggggtccctgagactctcctgtacagcctctggattcagcatcagttcgtattggatgaattgggtccgccaggctccagggaagggctggagtgggtgcaanataaagccagatggaggtgtaaaacngtatgtagactctgtggagggccggttcaccatctccagagacaacgccaaagaatgcgatatatctacagatgaacagcctgccgagccgagacacggctgtgtattacgtggtgggagtcccctgggctggcacctgtatccgaccgttggagtcgagggaactcgtggtcacccgtctcctcacgcctccaccaacgggcccacgtccgtccttcccccgtggcccgccctgcctccgacggacgccacccgttccgacgcgccaacgacggccggcccgtcgggcgtccgg

SEQ ID NO: 402771 - DNA, 664 bp, Homo sapiens
  misc_feature: GZ8MTXP01CHX0S.11.13.B02.1.454.CMB.2.raw
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaagggctggagtgggtgaccaacataaagccagatgggagtagtaaaacagtatgagactcgtggtggagggccgttcacatctcagagaacaacgccaagaatgacgatatatctacagatagaacagctgcccgagcgagacacggctgtgtattacgtgggtgggacgtcccgtgggctggctaccgtgtacgtccgtaccggttggacgtcgaaggggacctcgtcgggtacctacccggttctccctacgaccggtacccctacccgaacccgaaccggggtccctaaccgttcccggttccccttcccccccggtgggccccgtccccgttcggccccgttacccggaacgggaaccccgtcccgttaaccccgttccgggaacgaaccgggaccgaaccgacccgggcccgggttccccggtcggggttcccttcccggggg

SEQ ID NO: 402772 - DNA, 607 bp, Homo sapiens
  misc_feature: GZ8MTXP01D2RE5.11.13.B02.1.454.CMB.2.raw
  modified_base (234)..(234): a, c, t, g, unknown or other
  modified_base (329)..(329): a, c, t, g, unknown or other
  modified_base (339)..(339): a, c, t, g, unknown or other
  modified_base (389)..(389): a, c, t, g, unknown or other
  modified_base (579)..(579): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaagggctggagtgggtgccaanataaagccagatggagtagtaaaacagtatgagactctggtggagggccgttcaccatctccagagacaacgccaaagaatgcgaatatatctanagatgaaacngcctgccgagccgaggacacggctgtgtattacgtggtgggacgtcccgnggctcggctacctggtactccggaccgtttgggacgttcgaaggggtaactcgtcggtcctacccggttccttcccgtccacgtccccgtaccgaacccgtaaccggggcccctaagtcccggttcccttccccccgtcggcccgtccccttgccctcccgagggaccgcccacccgttccgacggaacncaacgacggccgggcccgtgggctccgg

SEQ ID NO: 402773 - DNA, 582 bp, Homo sapiens
  misc_feature: GZ8MTXP01C9IJR.11.13.B02.1.454.CMB.2.raw
  modified_base (509)..(509): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgagggaagggctggagtgggtgcaacataaagcagatggaggtagtaaacagtatgtagactgtggtggagggccggtcaccatctcagagacaacgccaaagaatgacgatatatactacagatagaacagcctgccgagcgagacacggctgtgtatacgtggtgggacgtcccgtggcgtcgcactgtacgtccgtaccggttaggtacgtcgaagggtaactcgtcggtccgaccgtcgtcctcacgccctaccaaccgaacggcccacgtccgtcccgttccccgtcggcccnccccgtgcctccgaggacgccacccgttccgacgaacgaccgcgacggccggttcccgtcgggttccgtccgg

SEQ ID NO: 402774 - DNA, 568 bp, Homo sapiens
  misc_feature: GZ8MTXP01A5Z1O.11.13.B02.1.454.CMB.2.raw
  modified_base (236)..(236): a, c, t, g, unknown or other
  modified_base (262)..(262): a, c, t, g, unknown or other
  modified_base (340)..(340): a, c, t, g, unknown or other
  modified_base (544)..(544): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgagggaagggctgggagtgggtgccaanataaagccagatggagtagtaaaacngtatgtagactctggtggagggccgttcaccatctccagagacaacgccaaagatgcgatatatctacagatgaaacngcctgccgagcgaggacacggctgtgtattacgtggtgggacgtcccgtggccgtcggcaccgtgtacgtccggaccggttggagtcgagggtactcgtcgtcaccgtctcctcacgcctccgaccgacgggcccacgtccggttccttccccgtcggccgccctcgcctccgacggacgtccacccgttccgacgcgcgaacncggcccggcccgtcgggcgtccgg

SEQ ID NO: 402775 - DNA, 569 bp, Homo sapiens
  misc_feature: GZ8MTXP01A2GOF.11.13.B02.1.454.CMB.2.raw
  modified_base (268)..(268): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttgggtccaggccgtgggggggtccctgagactctcctgtacagcctctggattcagcatcagttcgtattggatgaattgggtccgccaggctccgagggaaggggctggagtgggtggccaacataaagccagatggaggtgtaaaacngtatgtagactctggtggagggccggttcaccatctccagagacaacgccaaagaatgcgatatatctacagatgaacagcctgccgagcgaggacacggctgtgtatacgtgtgggagtccctggctggcacctgtactccgaccgttggagtcgagggaactctggtcaccgtctcctcacgccctccacccgaacgggccccacgtccggtcccttccccccgtgggcccgcccctgccctcccgacggacgccacccgttccgagaacgccaacacggccggcccgtgggctccggg

SEQ ID NO: 402776 - DNA, 669 bp, Homo sapiens
  misc_feature: GZ8MTXP01CVMS3.11.13.B02.1.454.CMB.2.raw
  modified_base (231)..(231): a, c, t, g, unknown or other
  modified_base (256)..(256): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaattgggtccgccagcctcgagggagggctggagtggtgcaanataaagcagatggagtagtaaaacngtatgtagactctggtggaggccgttcaccatctccagagacaacgccaaagaatgacgataatatctaacagatgaacagcctgccgagcgaggacacggcttgtgtattacgtggtgggactcccgtggcctggccacgtgtactcccgtaccgttgggacgttcgaggggtaaactccgtggtaccctacccggttcctccccgtacaaccggccccttaacccaaacccgaaaccggggccccctaaacggttcccggttaccccgtttccccccgtcggggccccgtccccgttcggcccttacccggaacggggtaaacccgacccgttaacccgttcccggaacgtaaccgacccgtaaccggaccggggtccccgggttaccccggttcggggttcccgtccggg

SEQ ID NO: 402777 - DNA, 576 bp, Homo sapiens
  misc_feature: GZ8MTXP01BG0HA.11.13.B02.1.454.CMB.2.raw
  modified_base (312)..(312): a, c, t, g, unknown or other
  modified_base (368)..(368): a, c, t, g, unknown or other
tcagcgagagataccacgaccggtgctcgatttagtctagcgactttgggtctgggggaggcttggtccagcctgggggggtccctgagactctcctgtacagcctctggattcagcatcagttcgtattggatgaattgggtccgccaggctccagggaaggggctggagtgggtggccaacataaagccagatggagtgtaaaacagtatgtagactctgtggagggccggttcaccatctccagagacaacgccaaagaatgcgatatatctacagatgaacagcctgcgagccgaggacacggctgtntattactggtgggagtccctggctggcacctgatcgacgttggagtcagggaactntgggtcaccgtctcctcacgcctccaccaacgggcccagtccggtccttccccgtggccgccctcgcctacgacggacggccaccgtcccgagacgccgacgacggccggcccgtcgggccttcggcccgtcgggtcaaacgggtaccttaccgttaccgtacttccgttcttccgtctcggcgtccggggcgttcggtcgaagccgg

SEQ ID NO: 402778 - DNA, 643 bp, Homo sapiens
  misc_feature: GZ8MTXP01ASBIJ.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacagtatgtagactctggtgggagggccgttcaccatctccagagacaacgccaagaatgcgatatatctaacagatgaacagcctgcgagccgagacacggctgtgtattacgtggtgggagtcccgtggctggcctacctgtactccggacgttggacgtacgagggtaactcgtcgggtacctacccggtctccctcgacgtcccctacccgaacccgaacgggcccctacgttcccggttccccttcccccgtcggccccgtccccgttcgcctaccgacgggaccgccacccgtccgagacgccgacgtcggcccgggcccgtcggggcctcgccgtaacgggtacaaacgggtaccttacccgttccgtattcccgttcgttccggtcgttacgggaacgggccggggcgttcgggtaaccgaagggccg

SEQ ID NO: 402779 - DNA, 605 bp, Homo sapiens
  misc_feature: GZ8MTXP01A1ALH.11.13.B02.1.454.CMB.2.raw
  modified_base (351)..(351): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaaggggctgggaggtgggtggccaacataaagccagatggaggtagtaaaacagtatgtagactcgtggtgggagggccgttcaccatctcagagacaacgccaaagatgacgatatatactacagatagaacncgcctgccgacggcgaggacgacggctgtgtattacgtgggtgggtacgtcccgtggctggccacgtgtactcccggacgttggagtcgaacgggactcgtcggtccacccggtctccctacgaccgccctacccgaccggaacggccctacgtcccggtcccttcccccgcggccctccccttcgccgtaccggcgccgtacccttccgacgacgaaccgcgaacggccggtcccggccggtcgttcgtccgg

SEQ ID NO: 402780 - DNA, 526 bp, Homo sapiens
  misc_feature: GZ8MTXP01D80UV.11.13.B02.1.454.CMB.2.raw
  modified_base (264)..(264): a, c, t, g, unknown or other
  modified_base (419)..(419): a, c, t, g, unknown or other
  modified_base (479)..(479): a, c, t, g, unknown or other
  modified_base (491)..(491): a, c, t, g, unknown or other
  modified_base (510)..(510): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtgtaaaacngtatgtagactctggtggagggccggttacaccatctccagagacaacgccaaagatgcgatatatctacagatgaacagcctgccgagccgaggacacggctgtgttattacgtgtgggacgtcccgtggctggcactgtatccgacgttaggngtcgagggactcgtggtcaccgtctctcagcctccaccaggccatcgtcctcccctgccncctgctccagcncaccgttccgagcgcaacncgcggccctgggctcg

SEQ ID NO: 402781 - DNA, 550 bp, Homo sapiens
  misc_feature: GZ8MTXP01AE05E.11.13.B02.1.454.CMB.2.raw
  modified_base (237)..(237): a, c, t, g, unknown or other
  modified_base (263)..(263): a, c, t, g, unknown or other
  modified_base (445)..(445): a, c, t, g, unknown or other
  modified_base (488)..(488): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgagggaaggggctgggagtgggtgccaanataaagccagatggaggtgtaaaacngtatgtagactctggtggagggccgttcaccatctccagagacaacgccaaagaatgcgatatatctacagatgaacagcctgcgagcgaggacacggctgtgtattacgtggtggggagtccctgggctggcaccgtgtactccgacgttggagtcgagggactcgtgtcaccgtctctcncgcctccaccgaagggcccacgtccgtcccttccccgcggccnccctgcctcccgaggcgccaccgttccgagaacgcaacgcggccggcccgtcggggctccgg

SEQ ID NO: 402782 - DNA, 590 bp, Homo sapiens
  misc_feature: GZ8MTXP01DGFZ1.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaagggctggagtgggtggcaacataaagcagatggaggtagtaaaacagtatgtagactcgtggtggagggccgttcaccatctccagagacaacgaccaaagaatgacgatatatctacagatagaacagcctgccgagcgagacacggctgtgtattacgtggtagggacgtcccgtgggcgtggcctaccgtgtacgtccggtacggttagggacgtcgagggtactcgtcgtcctacccgtctcctcgacgccctccaccgacggccctacgtccgtccttcccccgtcggcccgtcccgtcgcctccgacggaccgccacccgttcgacgcgaccgaacgcggcccggttcccgtcgggccgtccggg

SEQ ID NO: 402783 - DNA, 617 bp, Homo sapiens
  misc_feature: GZ8MTXP01A8TSZ.11.13.B02.1.454.CMB.2.raw
  modified_base (236)..(236): a, c, t, g, unknown or other
  modified_base (261)..(261): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctcgaggggagggctggagtgggtgcaanataaagccagatggagtagtaaaangtatgtagactctggtggagggccggttcacctatcctccagagacaacgccaaagaatgcgaatatatctaacagatagaacagcctggccgagcgaggacacggctgtgtaattacgtggtcgggacgtccccgtgggccgtggcctaccgtgtaacgtccggtaccggttgggacggttacgaggggtaaccttcgtcgggtcctacccgtctccgtcaccgtcccgtaccaccgaacggcccctacgtcccggtcccttcccccgtcggcccgtcccgtcgcctaccgaggaccgccacccgttccggacgaacgccgaacgacgggcccggttacccgtcggggcgtccgg

SEQ ID NO: 402784 - DNA, 591 bp, Homo sapiens
  misc_feature: GZ8MTXP01AY8SA.11.13.B02.1.454.CMB.2.raw
  modified_base (267)..(267): a, c, t, g, unknown or other
  modified_base (493)..(493): a, c, t, g, unknown or other
  modified_base (534)..(534): a, c, t, g, unknown or other
  modified_base (539)..(539): a, c, t, g, unknown or other
  modified_base (552)..(552): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgaggggaaggggctgggagtgggtggccaacataaagccagatgggaaggtgtaaaacngtatgtagactcgtggtggagggccggttcaccatctccagagacaacgccaaagaatgcgtatatatctacagatgaaacagcctgccgaggcgaggacacgggtctgttgtatttacgtggtcggggacgttccccgtgggccttgggcctaacccgttggtaacctcccggtacgggtttggacgtacgaggggtaaccttcgtggtccacccgttctccctnaccgccctaccaccgacgggccctagtcccgtcctccccgnggccncctgctcgaggcncaccgttcgagaagccaacgcgtccgcccgtgggctcgg

SEQ ID NO: 402785 - DNA, 677 bp, Homo sapiens
  misc_feature: GZ8MTXP01B7DNC.11.13.B02.1.454.CMB.2.raw
  modified_base (235)..(235): a, c, t, g, unknown or other
  modified_base (373)..(373): a, c, t, g, unknown or other
  modified_base (419)..(419): a, c, t, g, unknown or other
  modified_base (631)..(631): a, c, t, g, unknown or other
tcagcgagagataccacgaccggtgctcgatttagtctagcgactttgggttctccttgttgctattttagaaggtgtccagtgtgaggcgcagatgggtggggtcgtggggggaggcttggtccagccgtgggggggtccctgagactctcctgtacagcctctggattcagcatcagttcgtattggatgaagttgggtccgcaggctccgaggggaagggctgggagtgggnggaccaacaataaagccagatgggaaggtagtaaaacagtatgtagactcgtggtggacgggcccggttacaccctatcctaccagaacgaacaacgaccaaagaatgacgataatatactaacagaatagaacagcngaccgagcgagacacggctgtgtattacgtgggtcgggacgtccgngcgtggacctaccgtgtaccgtccggacgttaggacgtacgacgggtaacttcgtggtacccaccggttctccctacgaccgtccccgtaccccgaaaccgtaaccggggccccttacgttcccccgggttccccttcccccgggtcgggcccctaaccccgtcgttcccgacccgagggaaccccgccttaaccccggttcgaacggaacncccaaccgggtcccggcccgggttccccggtggggccgttcccggg

SEQ ID NO: 402786 - DNA, 609 bp, Homo sapiens
  misc_feature: GZ8MTXP01BG38U.11.13.B02.1.454.CMB.2.raw
  modified_base (408)..(408): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacagtatgtagactctgtggagggccgttcaccatctccagagacaacgccaagaatgcgatatatctacagatgaacagcctgcgagccgaggacacggctgtgtattacgtggtggggacgtcccgtggctggccaccgtgtactccggacgttgggacgtacgagggaactcgtcgggtccacccgtctcctcgaccnccctccaaccgacgggccctagtcccggtcccttcccccgtggcccgcccctgcctccgacggcgccacccgtccgagacgccacgacggccggcccgtgggcctcggcccgtgggtaccgaaacgggtcccttaccgttccgtattccgttcttccggtaacgtcgggaacggccggggtcgttcgggcgaacggggccg

SEQ ID NO: 402787 - DNA, 640 bp, Homo sapiens
  misc_feature: GZ8MTXP01A9MH6.11.13.B02.1.454.CMB.2.raw
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctcgagggagggctggagtgggtgccaacataaagccagatggaggtagtaaaacagtatgtagactcgtggtggagggccggttcaccatctccagagacaacgaccaaagatgcgatatatctacagatagaacagcgtgccgaggccggaggacgacggtctggtgtattacgtgggtacgggtacgtccgtgggtctcgggcctaccgttgtacgtccggtacggttgggacgttacgaaggggtactcgtcgggtacctacccgttctacccgtcgacgtcccctaccgaacccgacgggtcccctaggttccccgttccccgttccccgcgggccccgtccccgttgaccccgtaccggagggaccgccccacccggttccgagaaccgcaaccggtcgggcccggttccccgtggggttccctccggg

SEQ ID NO: 402788 - DNA, 626 bp, Homo sapiens
  misc_feature: GZ8MTXP01C5VW5.11.13.B02.1.454.CMB.2.raw
  modified_base (241)..(241): a, c, t, g, unknown or other
  modified_base (361)..(361): a, c, t, g, unknown or other
tcagcgagagataccacgaccggtgctcgatttagtctagcgactttgggttctccttgttgctattttagaaggtgtccagtgtgaggcgcagatgggtggggtcgtggggggaggcttggtccagccgtgggggggtccctgagactctcctgtacagcctctggattcagcatcagttcgtattggatgaagttgggtccgccaggctccgaggggaagggctggagtgggtgccaanataaagcagatggaggtagtaaaacagtatgtagactcgtggtggacggggccggttacaaccctatcctaccaagaacgacaaaccgaccaaaggtaatgacgtaataatatacctaanagatagaacagcctgccgagccgagacacggctgtgtattacgtggtgggactcccgtggctggctaccgtgtacgtccggtacggttagggacgttacgacggggtaactcgtacggtaccacccggttcgtcccttcgacggccctacccgaaccgaacgggcccacgttcccgggtcccttcccccggtcggcccgtccccttgccgtccgaggaacgcccaccgttcgacgaacgcaacgcggtccgccgtcgggctccgg

SEQ ID NO: 402789 - DNA, 727 bp, Homo sapiens
  misc_feature: GZ8MTXP01A5T74.11.13.B02.1.454.CMB.2.raw
  modified_base (272)..(272): a, c, t, g, unknown or other
  modified_base (645)..(645): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaagggctgggagtgggtgaccaacataaagccaagagtgggaaggtagtaaaacngtatgtagactcgtggtggacgggccgtcaccatctccagacgacaacgacaaagaatgacgattaatatactaacagtatacgaaacagtccgtaggccccggacggaccggtaaggaccgacgggtcttaggttcgttagtttaccggtgggtacggggtaccgttccccggtgggtccttcgggaccctaccggttacggtaccgttccccgggtaacccgggtttaggggaacgttaccggtaacgggggtaacccttcgggttacgggtaccctaccccggttccttaccccgtacgtaacccgcccccttaacccgaacccggtaaccgggtcccctacggtttccccgggtcccctttcccccggnggtccccgcccttcgacccgtccgagggtacccgcccgacccgcggacgcgccgtaacggcggcccggccggtcggccgtcg

SEQ ID NO: 402790 - DNA, 555 bp, Homo sapiens
  misc_feature: GZ8MTXP01DIGY8.11.13.B02.1.454.CMB.2.raw
  modified_base (290)..(290): a, c, t, g, unknown or other
  modified_base (491)..(491): a, c, t, g, unknown or other
  modified_base (497)..(497): a, c, t, g, unknown or other
  modified_base (517)..(517): a, c, t, g, unknown or other
  modified_base (533)..(533): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgagggagggctggagtgggtgccaacataaagccagatggaggtgtaaaacagtatgtagactctggtggagggccggttnaccatctccagagacaacgcaaagatgcgatatatctacagatgaacagcctgccgagcgaggacacggctgtgtattacgtggtgggactccgtggctggcaccgtgtactccggacggttggagtcgaaggggtactcgtcggtcctaccgtctccctcacgccctccgaaccgacggcctacgtccgtccctccccgnggcccncctcgcctccgaggccgccnccgttcgacgcgaccncgcggccgccgtcgggctccgg

SEQ ID NO: 402791 - DNA, 543 bp, Homo sapiens
  misc_feature: GZ8MTXP01DQ2L5.11.13.B02.1.454.CMB.2.raw
  modified_base (445)..(445): a, c, t, g, unknown or other
  modified_base (484)..(484): a, c, t, g, unknown or other
  modified_base (507)..(507): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctcgagggagggctggagtgggtgcaacataaagcagatggaggtataaaacagtatgtagactctgtggagggccgttcaccatctccagagacaacgccaaagatgcgatatatctacagatagaacagcctgccgagaccgaggacacggcttgtgtattacgtggtggggacgtcccgtgggctggcactgtactccgacgttggagtcagggactcgtggtcaccgtctcctcncgccctccaccgacgggcccagtccggtcccttccccgnggccgtccctgcctccgaggacncaccgttcgagcgcaacgcgccggccgtgggctcgg

SEQ ID NO: 402792 - DNA, 608 bp, Homo sapiens
  misc_feature: GZ8MTXP01CIY19.11.13.B02.1.454.CMB.2.raw
  modified_base (235)..(235): a, c, t, g, unknown or other
  modified_base (533)..(533): a, c, t, g, unknown or other
  modified_base (563)..(563): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgcaggctcgagggagggctggagtgggtgacaanataaagcagatggagtagtaaacagtatgtagactcgtggtggacgggccggttcacatctccagacgaacaacgaccaaagaatgacgatatatctaacagatagaacacgcctgacccgacggacggaggaccgacggtcttggtgtattacgtgggtcgggacgtcccgtggctcggctaccgtgtacgtcccggtacggttgggacgtcgaacgggtaacttcgtcggtacctaccgttctccctcacgccctaccgaaccgaaccgggccctacgtcccggtcccttccccgnggcccgtccctagcctaccgagggaacccnccacccgcgacgcgccgaacgcggcccggttccgtcgggcgtcgg

SEQ ID NO: 402793 - DNA, 606 bp, Homo sapiens
  misc_feature: GZ8MTXP01CUBAW.11.13.B02.1.454.CMB.2.raw
  modified_base (586)..(586): a, c, t, g, unknown or other
tcagcgagagataccacgaccggtgctcgatttagtctagcgactttgggtctggggggaggcttggtccagcctgggggggtccctgagactctcctgtacagcctctggattcagcatcagttcgtattggatgaattgggtccgccaggctccagggaaggggctggagtgggtggccaacataaagccagatggaggtagtaaaacagtatgtagactctgtggagggccgttcaccatctcagagacaacgcaagaatgcgatatatctaacagatagaacagcctgcgagccgaggacacggctgtgtattacgtggtgggacgtccgtggctcggcacctcgtactccgaccggttggacgtacgaagggaactcgtaggtccacccgtcgtccctcgacgccctccaacccgaacgggccctacgttcccggttaccttccccccgtcggcccgccccttcgcctacccgacggtcgaccctacccgtaccgagacgccacgacggcccgggtccctcggggcctcgcccgttgggaaccacgggtacttaccgttcgtattccgttcttcgcgtagnggcgggcttcggcaacgggc

SEQ ID NO: 402794 - DNA, 641 bp, Homo sapiens
  misc_feature: GZ8MTXP01CA99N.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaaggggctgggagtgggtgcaacataaagcagatgggaggtagtaaaacagtatgtagactcgtggtggagggccggttcaccatctcagagacaacgaccaaagaatgacgatatatctaacagatagaacagcctggacccgaggcggaaggaccacggtcttggtgttattacgtgggtcggggacgtcccgtgggtcgtcggcctaccgttggtaccgtcccggtaccgggttagggacgtcgaacggggtaccttcgtcggtaccctacccgttcctccctacgaccgtcccctaccgaacccgaacgggcccctacgttcccggtcccttccccgtggcccctccccgtgccctccgacggtaccgcccacccgttcggacgcgccaacggcggcccgggcccgtggggccgtccggg

SEQ ID NO: 402795 - DNA, 585 bp, Homo sapiens
  misc_feature: GZ8MTXP01EZBQ7.11.13.B02.1.454.CMB.2.raw
  modified_base (533)..(533): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactctggtggagggccggttcaccatctccagagacaacgccaaagatgcgatatatctacagatgaacagcctgccgagcgaggacacggctgtgtattacgtggtcggggactcccgtgggctgggccaccgtgtactccggaccggtttggagtcgagggactcgtcggtccaccgtctcctcacgccctccgaccgaacgggcccagtcccggttccctcccccgtggcccgccctcgccgtcccgagggaccnccaacccgttccgacgcgccgaacgacggcccggccccgtggggcctccggg

SEQ ID NO: 402796 - DNA, 610 bp, Homo sapiens
  misc_feature: GZ8MTXP01A5XJ9.11.13.B02.1.454.CMB.2.raw
  modified_base (263)..(263): a, c, t, g, unknown or other
  modified_base (405)..(405): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgcaggctccgaggggagggctggagtgggtgcaacataaagccagatggaggtagtaaaacngtatgtagactcgtggtggagggcccggttcaccctatcctcccaagagacaaccgccaaagaatgacgataatatactacagatagaacagcctgccgagcgaggcacggctggtgtattacgtgggtggggacgtcccgngggtctcggcctacgtgtactccggtaccggttgggacgtcgagggtacctcgtcggtcctaccgtcctccgtactccgccctaccgaccgaccgggcctaaccgtccgttccccgtccccgtcggcccgtccccgtcgccgtccgacggaccgtccttacccggccgagaacgcgaaccgcggcccggccgtcgggccgtccgg

SEQ ID NO: 402797 - DNA, 640 bp, Homo sapiens
  misc_feature: GZ8MTXP01DEOHQ.11.13.B02.1.454.CMB.2.raw
  modified_base (202)..(202): a, c, t, g, unknown or other
  modified_base (229)..(229): a, c, t, g, unknown or other
  modified_base (236)..(236): a, c, t, g, unknown or other
  modified_base (261)..(261): a, c, t, g, unknown or other
  modified_base (397)..(397): a, c, t, g, unknown or other
  modified_base (412)..(412): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaagttggtccncaggctcgagggagggctggagtgggngaccaanataaagcagatggaggtataaaacngtatgtagactcgtggtggaggccgttcaccatctaccgagacgaacaaccgacaaagaatgacgaatatactactaacagatagaaacacgtcctaggacccgacggacgaaggacgacggtctgtgtattacgnggtcgggacgtccgngtcgtggcctactgtacgtaccggtacgttgggacgtcggaacggtactcgtacggcctaccgtctccttacgccgtaccctaccgaacccgaaccggtccctaaccgttcccggtcccctttcccccggcggtccccgtcccgttcgcccgtcccgaacgggacctacccacccgttcggacgaaccgacgtaaccgccggcccggcccggttcgggcgttcccggg

SEQ ID NO: 402798 - DNA, 576 bp, Homo sapiens
  misc_feature: GZ8MTXP01C0EE6.11.13.B02.1.454.CMB.2.raw
  modified_base (236)..(236): a, c, t, g, unknown or other
  modified_base (273)..(273): a, c, t, g, unknown or other
  modified_base (466)..(466): a, c, t, g, unknown or other
  modified_base (516)..(516): a, c, t, g, unknown or other
  modified_base (532)..(532): a, c, t, g, unknown or other
  modified_base (548)..(548): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctcgagggagggctggagtgggtcgacaanataagcagatggagtataaacagtatgagactgtggnggacggccgtcacatcacagacgacaacgacaaagatgactatatatctaacagatagaacacgctcgaccgacggacggaggaccgacggtcttggtgttacttacggtgggtacggggcgtcccgtgggcgtgcctacgtcgtacgtccgtacggtggacgtcgaggtactcgtcgtaccgtccgtctccncgactccccgacgaaccgtaccggcctacgtccgttccctccccgtgccncctgcctcgacggacnccacccgttcgacgcncaacgtcggccggttccgtcggcgtccg

SEQ ID NO: 402799 - DNA, 575 bp, Homo sapiens
  misc_feature: GZ8MTXP01BBRM8.11.13.B02.1.454.CMB.2.raw
  modified_base (262)..(262): a, c, t, g, unknown or other
  modified_base (290)..(290): a, c, t, g, unknown or other
  modified_base (331)..(331): a, c, t, g, unknown or other
  modified_base (549)..(549): a, c, t, g, unknown or other
  modified_base (554)..(554): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaattgggtccgccaggctccagggaaggggctggagtgggtgccaacataaagccagatgggaggtgtaaaacngtatgtagactctgtggagggccggttnaccatctccagagacaacgccaaagaatgcgatatatctanagatgaacagcctgccgagcgaggaccacggctgtgtattacgtggtgggactccccgtgggcctgggcaccgtgtactccgaccggttggagttcgaggggaacttcgtcggtaccaccgtcctcctcacgccctcccacccgaacggggcccctagtcccggttccttccccccgtggcccgtccctgcctcccgaggacgccaccgttccgagcncaacncggccggcccgtgggcctcgg

SEQ ID NO: 402800 - DNA, 578 bp, Homo sapiens
  misc_feature: GZ8MTXP01E0O8U.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactcgtggtggagggccgttcaccatctccagagacaacgccaagaatgcgatatatctacagatgaacagcctgccgagcgagacacggctgtgtattacgtgggtggggacgtcccgtgggcgtggcacctgtactccgacgttggagtcgagggactcgtggtccaccgtctcctcacgccctaccgaccgacggcccagtcccggtcccttcccccgcggcccgtccccgtcgcccgtcccgagggaccgtcccaccgttccgacgcgcaacgcggcccggcccgtgggcctccgg

SEQ ID NO: 402801 - DNA, 585 bp, Homo sapiens
  misc_feature: GZ8MTXP01CSFJ5.11.13.B02.1.454.CMB.2.raw
  modified_base (269)..(269): a, c, t, g, unknown or other
  modified_base (541)..(541): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatgggaggtagtaaaacngtatgtagactcgtggtggagggccggttcaccatctccagagacaacgccaaagaatgcgatatatctaacagatgaacagcctgccgagcgaggacacggctgtgtattacgtggtgggactcccgtggctgggcctacgtgtactccggtacgttggacgttcgaagggtactcgtcggtccaccgtctcctcacgccctccgaacccgaacgggccctaacgtcccggttccctcccccgtcggcccgtcccctgccctccgaggacnccaccgttccgagaacgccaacgcggccggcccgtgggctccgg

SEQ ID NO: 402802 - DNA, 641 bp, Homo sapiens
  misc_feature: GZ8MTXP01B6STL.11.13.B02.1.454.CMB.2.raw
  modified_base (271)..(271): a, c, t, g, unknown or other
  modified_base (351)..(351): a, c, t, g, unknown or other
  modified_base (382)..(382): a, c, t, g, unknown or other
  modified_base (603)..(603): a, c, t, g, unknown or other
tcagcgagagataccacgaccggtgctcgatttagtctagcgactttgggttctccttgttgctattttagaaggtgtccagtgtgaggcgcagatgggtgggggtctggggggaggcttggtccagccgtggggggtccctgagactctcctgtacagcctctggattcagcatcagttcgtattggatgaattgggtccgccaggctccgaggggaaggggctgggagtgggtgaccaacataaagccagatgggaaggtagtaaaacngtatgtagactcgtggtgggagggccggttcaccatcctaccgagagaaccaacgccaaagaatgacgattatatctaanagatagaacagctgccgacggaccgaggacncggtcttggtgtattacgtgggtcggggacgtcccgtgggctcggcctaccgtggtactccggtacggttagggacgttcgaagggtacttcgtcggtccctaccgttctcctcgaccgtccctacccgaccggaacggccctacgttcccggttccccttccccgcgggccccaacccgttcgccgtaccggacggtaccgcccttacccggcgaacgcnccgaacgtcgggccccgggccgtggggcccttccgggg

SEQ ID NO: 402803 - DNA, 653 bp, Homo sapiens
  misc_feature: GZ8MTXP01A89MZ.11.13.B02.1.454.CMB.2.raw
  modified_base (237)..(237): a, c, t, g, unknown or other
  modified_base (264)..(264): a, c, t, g, unknown or other
  modified_base (300)..(300): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaattgggtccgccaggctccgaggggaagggctgggagtgggtgccaanataaagccagatggaggtagtaaaacngtatgtagactctggtggacgggccgttcaccatcnccagagacaacgcaagatgcatatatctacagatgaacacgctgcccgagccgaggaccgacggcttgtgtattacgtggtcgggtacgtcccgtgggctggcctacccgttgtaccgtcccggtaccggttgggacgtacgaaggggtaaccttcgtcggtcctacccggttctcccgtacaccgtcccctacccaaccggaaccgggcccctacgttccccggttccccgttccccccgtcgggccccctccccgttagccccgtaccggacgggaccgtacccacccgttcccggagaaccgcccgaaccggaccgggcccgggttccccggtgggggttcccttccggg

SEQ ID NO: 402804 - DNA, 617 bp, Homo sapiens
  misc_feature: GZ8MTXP01AYGO0.11.13.B02.1.454.CMB.2.raw
  modified_base (259)..(259): a, c, t, g, unknown or other
  modified_base (330)..(330): a, c, t, g, unknown or other
  modified_base (339)..(339): a, c, t, g, unknown or other
  modified_base (391)..(391): a, c, t, g, unknown or other
  modified_base (557)..(557): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggagggctggagtggtgccaacataaagccagatggaggtagtaaaacngtatgtagactcgtggtggagggccggttcaccatctccagagacaacgaccaaagatgcgatatatctanagatgaacngcctggccgagccggaggacgcggtactgtgtatacgtggtgggacgtccgngctcggctacgtgtactcccggacggttacggagtcgaaggggaaccttcgtcggtaccacccggttcctacccgtcgaccgcccctacccgaaccgaaccgggtccctaccgttccggtccccttcccccggtcggccccgtcccctcgccgtcccgacggtacncccgttacccgccgacggaacgcgtaaccgcggcccggttcccggtcgggccgtcccggg

SEQ ID NO: 402805 - DNA, 636 bp, Homo sapiens
  misc_feature: GZ8MTXP01D9HSL.11.13.B02.1.454.CMB.2.raw
  modified_base (472)..(472): a, c, t, g, unknown or other
  modified_base (478)..(478): a, c, t, g, unknown or other
tcagcgagagataccacgaccggtgctcgatttagtctagcgactttgggtctggggggaggcttggtccagccgtggggggtccctgagactctcctgtacagcctctggattcagcatcagttcgtattggatgaattgggtccgccaggctccgaggggaaggggctgggaggtgggtggccaaacaataaaagccagagtggaggtagtaaaacagtatgtagactctggtggagggtccggttcaccatctcagagacaacgcaagaatgcgatatatctacagatagaacagcctgacgagccgaaggacgacggtctgttagtattacgtggtcgggacgtcccgtggcgtcggcctaccttcgtacgtccgtacggttggacgtacgaagggtaactcgtcggtccaccgtctcctcacgtccctaccaccgaacgggccctacgtcccgttacccttccccgnggcccnccctcgccctaccgacggaccgcctacccgtccgaagacgccgaccgacggcccggcccgtcggggccttcggcccgttaagggtccgaaaggtacccttacgttccgtacttccgttcgttccgtcgtaggccggcgggcttacgggcgaagggccg

SEQ ID NO: 402806 - DNA, 551 bp, Homo sapiens
  misc_feature: GZ8MTXP01B8B82.11.13.B02.1.454.CMB.2.raw
  modified_base (266)..(266): a, c, t, g, unknown or other
  modified_base (274)..(274): a, c, t, g, unknown or other
  modified_base (337)..(337): a, c, t, g, unknown or other
  modified_base (346)..(346): a, c, t, g, unknown or other
  modified_base (493)..(493): a, c, t, g, unknown or other
  modified_base (531)..(531): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaagggctgggagtgggtggccaacataaagccaagatggaggtgtaaaacngtatgtanactctggtggacgggccggttcaccatctccagacgacaacgccaagaatgcgatatatctanagatgaacngctgccgagcgaggacacggctgtgtattacgtggtgggacgtcccgtgggctggcaccgtgtactccgacgttggacgtcgagggactcgtgtaccaccgtctcctcacgccctccaccgacgggccctacgtccgtcctccccgnggcccgccctcgctccgaggcgccaccgttcgagcgcncgcgccggcctcgggctcgg

SEQ ID NO: 402807 - DNA, 724 bp, Homo sapiens
  misc_feature: GZ8MTXP01BQ0OC.11.13.B02.1.454.CMB.2.raw
  modified_base (273)..(273): a, c, t, g, unknown or other
  modified_base (365)..(365): a, c, t, g, unknown or other
tcagcgagagataccacgaccggtgctcgatttagtctagcgactttgggttctccttgttgctattttagaaggtgtccagtgtgaggcgcagatgggtgggggtctggggggaggcttggtccaggccgtgggggggtccctgagactctcctgtacagcctctggattcagcatcagttcgtattggatgaattgggtccgccaggctccgaggggaagggctgggagtgggtgaccaacataaagccagagtgggaaggtagtaaaacngtatgtagactcgtggtggacgggccggttacaccatctaccagacgacaacgaccaaagaatgacgtatatatactaacaagatagaaacncgccgtgccggacggaccggaggaccgacggcttaggttgtaacgttacggtgggtacggggacgttccggtgggtccgtcggctaccgtgtaccgttcccggtacggttagggacgtacggtaacggggtaccttcgtcggtacctacccggttctcccgtacgacccgtcccgtacccgaacccggtaacggggtccccttacggttccccgggttcccccttcccccgggtcgggtcccccgtccccgtttcggcccgtaccccgggagggacccgtccccgttacccggttcccggacggaaccggcccgaacccgcgggggtccccggccccgggtttggggcccgttccgggg

SEQ ID NO: 402808 - DNA, 571 bp, Homo sapiens
  misc_feature: GZ8MTXP01CV7RI.11.13.B02.1.454.CMB.2.raw
  modified_base (231)..(231): a, c, t, g, unknown or other
  modified_base (256)..(256): a, c, t, g, unknown or other
  modified_base (262)..(262): a, c, t, g, unknown or other
  modified_base (299)..(299): a, c, t, g, unknown or other
  modified_base (333)..(333): a, c, t, g, unknown or other
  modified_base (343)..(343): a, c, t, g, unknown or other
  modified_base (363)..(363): a, c, t, g, unknown or other
  modified_base (376)..(376): a, c, t, g, unknown or other
  modified_base (484)..(484): a, c, t, g, unknown or other
  modified_base (490)..(490): a, c, t, g, unknown or other
  modified_base (500)..(500): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaagttgggtccgcaggctcgaggggagggctgggagtgggngacaacataaagcagagtggagtanaaaacngtatgtagctcgtggtggagggccgctccaccatccnccagacgacaacgaccaagatgcgatatatctanagatagaacngcctgcgagcgagcaacggntgtgtatcgtggngggctccgtgctgctcgtgtactccgtacggttggagtcgaggactcgtgtccacggtctcctcacgccctaccgaccgacggccctacgtcccggtcccttccccgnggcccncccgcgtccnccggaacggccttccgacccgttccggaacgacgaaccgaccggtacggcccggtcccggttcgggtcccg

SEQ ID NO: 402809 - DNA, 665 bp, Homo sapiens
  misc_feature: GZ8MTXP01EELP3.11.13.B02.1.454.CMB.2.raw
tcagcgagagataccacgaccggtgctcgatttagtctagcgactttgggtctgggggaggcttggtccagcctgggggggtccctgagactctcctgtacagcctctggattcagcatcagttcgtattggatgaattgggtccgccaggctccgagggaaggggctggagtgggtgccaacataaagccagatggaggtagtaaaacagtatgtagactctggtggagggccggttcacatctcagagacaacgccaagatgcgatatatctaacagatagaacagcctgcgagccgaaggacgacggctgtagttattacgtggtgggacgtccgtggcttggctacctgtactccgtacgttggagtacgaagggtaactcgtcggtacctaccgtcctcctcacgccctaccgaacccgaacgggccctacgtcccggttcccttcccccgtggccccgcccgttcgcccgtaccgacgggtaccgaccccgtacccgtacccggacgaaccgccgaaccgacgggccccgggtcccgtcgggggccgttaccgggccggttaacggtaccgaaacgggtacctttacccgttccggtaacttccgttcgttccgtcgttacggaacgggtccggggtcgcgggtaacgggaacggccgg

SEQ ID NO: 402810 - DNA, 606 bp, Homo sapiens
  misc_feature: GZ8MTXP01BQLGF.11.13.B02.1.454.CMB.2.raw
  modified_base (375)..(375): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgagggaagggctggagtgggtgccaacataaagccagatgggaggtagtaaaacagtatgtagactcgtggtgggacgggccggttcaccatctaccagagacaacgaccaaagatgcgatatatctacagtatgaacagactggaccgagccgagacacggctgtntattacgtggtcgggtacgtcccgtgggctcggctaccgtgtacgtccggtacggttacgggagtcgaacgggtactcgtcggtacctacccgtctcctcgacgccctaccaccgacggccctacgtccggtcccttcccccgtcggcccgcccgtcgccctaccgacggaccgcccttacccgccgacgaaccgccgaaccgcgggcccggcccgtcggggccgtccggg

SEQ ID NO: 402811 - DNA, 679 bp, Homo sapiens
  misc_feature: GZ8MTXP01ETZSB.11.13.B02.1.454.CMB.2.raw
  modified_base (272)..(272): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaagttgggtccgccaggctccgaggggaagggctgggaggtgggtgaccaaacataaagccagatgggaggtagtaaaacngtatgtagactcgtggtgggacgggccgttcacctatcctaccgagacgaacaaccgaccaaagaatgacgtataatatatacaagtatacgaaacacgccgtggacccgacggaccggaggaccgacggtacttggttgttaacgtttacgtgggttacggggtaccgttcccggtgggtcctcgggcctacgttgtaccgtccggtacggttaggacgttcggaaggtacctcgtcggtacctaccgttcctccgtcgaaccgccctaccgaaccgacgggtcccacgttcccggttcccctccccgtcggcccgtaacccttcgcccgtaccggacggaccgacccacccggttcgaacgtccgaccgaaccgccgggcccggccgtcggggttcgttcccggg

SEQ ID NO: 402812 - DNA, 717 bp, Homo sapiens
  misc_feature: GZ8MTXP01B8Y79.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaagttgggtccgccaggctccgaggggaaggggctgggaggtgggtgaccaacataaagccagatggaggtagtaaaacagtatgtagactcgtggtggacgggccggttacacctatcctaccgagacgaaccaacgaccaaagaatgacgtaatatatactaacagatagaacagccgtgaccgacgacgaggacacggcttgtgtattacgtgggtcgggtacgtcccgtgggcgtcgcctacgtgtacgtccgtacggttggacgttcgaacggtactcgtacggtacctacccggttctacccgttacgaccgtaccccgttacccaaacccggaacccggggtccccttaaaccggttccccgggttcccccgtttccccccgggtcggggcccccgtccccgtcggccccgttacccggaaacgggaccgtccccgttaaccccgttcgggaaacggaaccgacccgaacccggtcggggacccccgggttcccggtcggggttccgttaacccggggg

SEQ ID NO: 402813 - DNA, 648 bp, Homo sapiens
  misc_feature: GZ8MTXP01DI0AR.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgaggggaagggctgggagtgggtgcaacataaagccagatggaggtagtaaaacagtatgtagactctgtggagggccggttcaccatctccagagacaacgccaagatgcgatatatctaacagatagaacagctgccgacgcgaggaccacggtctagtgtattacgtgggtgggacgtcccgtgggctcggctaccgtgtactccggacgttgggacgtcgagggaactcgtggtcctacccgttctccctcgaccgtccctacccgaaccgaaccggggcccctacgttcccggttcccctttccccccggtcggccccgtccccgttcgcccttacccggaagggtacccgcccgttaaccccgttcccgggaaacggccgacccgaaccggaccggtccccggggttccccggtcgggggcccgttccgggg

SEQ ID NO: 402814 - DNA, 626 bp, Homo sapiens
  misc_feature: GZ8MTXP01AVA2W.11.13.B02.1.454.CMB.2.raw
  modified_base (301)..(301): a, c, t, g, unknown or other
tcagcgagagataccacgaccggtgctcgatttagtctagcgactttgggtctgggggaggcttggtccagcctgggggggtccctgagactctcctgtacagcctctggattcagcatcagttcgtattggatgaattgggtccgccaggctccgaggggaaggggctggagtgggtggccaaacataaagccagatggaggtagtaaaacagtatgtagacttcgtggtgggacgggtccggttcacctatcctaccagagaacaacgaccaagaatgcgatatatctacagatgaacngcctgcgagccgaggacacggcttgtgtaattacgtggtgggacttcccgtggctggcctacctgtactccgacgttggacgtacgagggtaactcgtacggtccaccgttctcctcgactccctaccaccgtaacgggccctacgttcccgggttacccttcccccgtggccctcccgtgcccgtaccgacgggacggccctaacccgtccggaacgacgccgacgacggcccggcccgtgggctcggccgtggtacgaggtaccttcgttaccgtacttcgttccggcgttggacgtcgggtcgtggacgtaacgggctaacg

SEQ ID NO: 402815 - DNA, 604 bp, Homo sapiens
  misc_feature: GZ8MTXP01BHSXK.11.13.B02.1.454.CMB.2.raw
  modified_base (199)..(199): a, c, t, g, unknown or other
  modified_base (235)..(235): a, c, t, g, unknown or other
  modified_base (263)..(263): a, c, t, g, unknown or other
  modified_base (540)..(540): a, c, t, g, unknown or other
  modified_base (562)..(562): a, c, t, g, unknown or other
  modified_base (577)..(577): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccncaggctccgaggggagggctgggagtgggtgccaanataaagtcagatgggaggtagtaaaacngtatgtagactcgtggtggacgggccggttcaccatctccagagacaacgccaaagatgacgatatatactacagatagaacacgcctggaccgagaccggaggaccgacggcttgtgtattacgtgggtcgggacgttcccgtggcgttcggctaccgtgtactcccggtacgtttgggacgtcgaaggggtacttcgtcggtacctacccggttctacccgttcgaccgtcccctaccgaaccgaacgggccctacgtcccggtcccttccccgnggcccgccctgcctccgaggcnccaccgttcgacgcnccaacgcgccggttccgtgggctccgg

SEQ ID NO: 402816 - DNA, 589 bp, Homo sapiens
  misc_feature: GZ8MTXP01B4QN1.11.13.B02.1.454.CMB.2.raw
  modified_base (266)..(266): a, c, t, g, unknown or other
  modified_base (346)..(346): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatgggaggtagtaaaacngtatgtagactgtggtggagggcccggttcaccatctccagagacaacgccaaagaatgcgatatatctacagatgaacngcctgccgagccgaggacacggctgtgtattacgtggtgggacgtcccgtggctggcaccgtgtacgtccgacggttggacgtcgagggactcgtcgtccaccgtctccctcgaccgccctccgaccgaccgggccctacgtccgttcccttcccccgtgggccctccccgtgccctacccgacggtacgcccacccgttccgacggccgcaaccgacgggcccggcccgtcgggccgtccgg

SEQ ID NO: 402817 - DNA, 672 bp, Homo sapiens
  misc_feature: GZ8MTXP01C7DHK.11.13.B02.1.454.CMB.2.raw
  modified_base (203)..(203): a, c, t, g, unknown or other
  modified_base (231)..(231): a, c, t, g, unknown or other
  modified_base (237)..(237): a, c, t, g, unknown or other
  modified_base (276)..(276): a, c, t, g, unknown or other
  modified_base (304)..(304): a, c, t, g, unknown or other
  modified_base (319)..(319): a, c, t, g, unknown or other
  modified_base (333)..(333): a, c, t, g, unknown or other
  modified_base (370)..(370): a, c, t, g, unknown or other
  modified_base (586)..(586): a, c, t, g, unknown or other
  modified_base (623)..(623): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttgggtccaggccgtgggggggtccctgagactctcctgtacagcctctggattcagcatcagttcgtattggatgaattgggccncaggctcgagggaagggctggagtgggngacaanataaagcagatggagtagtaaaacagtatgtagactcgnggtggagggccgttcaccatctacaganacaacgaccaaagangacatatatctaanagatagaacagtcctgacccgagacgaggacctacgngtactgttacgttaaagttcggttggtacggggtacgtccctggggtaccttcgggactaacccgttggtaacctaccccgggtaacggtttcgggaacgttacggaaagggtaccttcgttacggtcctaaccccggggttctaccccgtcaccggccccttacccgaacccggtaaacgggtcccctaacgttccccggttccccttcccccgnggggtcccctccccggttgcccttcggacgggtaccnccgacccttacggaagacgccaacggcggcccggtccgttcggggtccc

SEQ ID NO: 402818 - DNA, 662 bp, Homo sapiens
  misc_feature: GZ8MTXP01EF0OO.11.13.B02.1.454.CMB.2.raw
  modified_base (236)..(236): a, c, t, g, unknown or other
  modified_base (261)..(261): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctggggggtccctgagactctcctgtacagcctctggattcagcatcagttcgtattggatgaattgggccgccaggctccgaggggaagggctgggagtgggtgccaanataaagccagatggagtataaaacngtatgtagactctggtggacgggcccgttcaccgatcctaccgaagagaacaacgccaaagaatgacgaatatactactaacagatagaacagcctggaccgagccgtaaggaccacggtctgtcgtattacgtgggtacgggacgtcccgtgggccttgggacctacccgtgtacgtcccggacggtttggaacgttcgaacggggtaaccttcggtcggtacccacccggttctcccgtacgaccgcccctaccgaacccggtaacgggtccctaacggttcccggtcccctttccccgtcgggccctaaccccgtggcccttacccgaaagggcctcccacccggttccgagggaacaccttaacgcgggcccgggttacctcgggggttctccgggg

SEQ ID NO: 402819 - DNA, 632 bp, Homo sapiens
  misc_feature: GZ8MTXP01EYRO0.11.13.B02.1.454.CMB.2.raw
  modified_base (236)..(236): a, c, t, g, unknown or other
  modified_base (262)..(262): a, c, t, g, unknown or other
  modified_base (305)..(305): a, c, t, g, unknown or other
  modified_base (368)..(368): a, c, t, g, unknown or other
  modified_base (401)..(401): a, c, t, g, unknown or other
  modified_base (588)..(588): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctgggagtgggtgccaanataaagccagatggaggtgtaaaacngtatgtagactctggtggagggccggttcacctatctccaganacaacgccaaagatgcgatatatctacagatagaacagcctgccgagcgaggacacggctgtntatacgtggtgggactcccgtggccgttggccnccttagtactccggtacccggttagggtagtccgaggggtaaactcgtacgggtcctacccggtcttccgtaccgacgcccgtccccaaccgaaccggggcccctaaccgttccgggtcccttccccccgtcggcccgtccccgtcgaccgtcccgacgggacgtccccgacccgttccggaacggngacccgaacgaccggccggggccccttaacggggccgtcccggg

SEQ ID NO: 402820 - DNA, 710 bp, Homo sapiens
  misc_feature: GZ8MTXP01CVAXY.11.13.B02.1.454.CMB.2.raw
  modified_base (299)..(299): a, c, t, g, unknown or other
  modified_base (303)..(303): a, c, t, g, unknown or other
  modified_base (329)..(329): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgagggaagggctgggagtgggtgaccaacataaagccagatggaggtagtaaaacagtatgtagactctggtggaggccgtcaccatcnccanagacaacgccaagaatgacgaataanatctaacagatagaaacagccctggccgaacgaccggaggaaccgacggtcgttgtggtacttaacgtggtggggactccccgtggctgggcacctagtactacccggacggtttaggacgttacgaaggggtaaaccttcgtacggtacctaacccggcgttccccttcaaaccggtccccttacccaaacccggaaaccggggtcccctaaaccgtccccgggtttaaccccttcccccccggttggggccccgtcccccgttacgcccgtttccccggaaagggaacccggtaccttaaccccgccgaacgggaaaaccgcccggttaaccggaacgggtcccccgggaccccgggtttcgggggccctttccggggg

SEQ ID NO: 402821 - DNA, 629 bp, Homo sapiens
  misc_feature: GZ8MTXP01CYBS4.11.13.B02.1.454.CMB.2.raw
  modified_base (360)..(360): a, c, t, g, unknown or other
  modified_base (573)..(573): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggagtgtaaaacagtatgtagactctgtggagggccggttcaccatctccagagacaacgccaagaatgcgatatatctacagatgaacagcctgcgagccgaggacacggctgtgtattacgtggtgggagtcccgtggctggcacctgtactccgacggttggngtacagggaactgtcggtccaccgtctcctcgctccctaccgaccacgggccctacgtccggtacccttccccgtcggcccgcccgtcgtcctacccgacgggacggcccgaacccgtccgaacgacgccgaaccgcggacccgggcccgtcgggggtcctcggcccgtcgggttacgaaacggggttacctttaccgttacccggtttaccnccgttccgttccgtggtcggaacgggtcggggcgttcggggaaccgaaggtaaccg

SEQ ID NO: 402822 - DNA, 629 bp, Homo sapiens
  misc_feature: GZ8MTXP01AL0G9.11.13.B02.1.454.CMB.2.raw
  modified_base (268)..(268): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaagggctgggagtgggtgaccaacataaagcagatggaaggtagtaaaacngtatagagactcgtggtggacgggccggttcaccatctaccagacgaacaacgaccaaagaatgacgaataatactactaacagaatagaaacacgctgcccggaggaccgaggacgacggcttgtcgtattcgtggtcgggacgtccgtggctggactacgtgtactccggacggttgggactacgaagggtactcgttacgtccaccgttctaccgtcgacgcccctaccgaccggtaaccggccctacgtcccggttcccttccccgtgggcccctaacccgttcgccgttaccgacggaccgtcccacccgttcgacgaacgccgaacgcgggccggttacccgtgggccgtccggg

SEQ ID NO: 402823 - DNA, 536 bp, Homo sapiens
  misc_feature: GZ8MTXP01BB275.11.13.B02.1.454.CMB.2.raw
  modified_base (208)..(208): a, c, t, g, unknown or other
  modified_base (234)..(234): a, c, t, g, unknown or other
  modified_base (422)..(422): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgagggaaggggctggagtgggtggccaacataaagccagatggagtagtaaacngtatgtagactctgtggaggccgttnaccatctcagagacaacgcaagaatgcgatatatctacagatgaacagcctgcgagccgaggcacggctgtgtattacgtgtggggatccctggctggctacctgtactccggaccgttggacgtcaaggggtaactcgtcggtccaccgtctctcagcctccacaggcccatcgtcctcccctgccnccctgcctcaggcgcaccgtccgagacgcgactagccggcccgtgggctcgccgtcggcgacggaccttcgtcccgtattccttcttcgcgtgcggtgggcttgggccaaggcg

SEQ ID NO: 402824 - DNA, 699 bp, Homo sapiens
  misc_feature: GZ8MTXP01BYRK7.11.13.B02.1.454.CMB.2.raw
  modified_base (201)..(201): a, c, t, g, unknown or other
  modified_base (269)..(269): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccnccaggctccgaggggaaggggctgggagtgggtggccaacataaagccagatgggaggtagtaaaacngtatgtagactctggtggagggccgttcacctatctccagagacaacgaccaaagatgcatatatctaacagatacgaacacgctgaccgacggaccgaggaccacgggtacttggttgttaagttccgtggggtcgggtacggttccccgtgggccgtcggccgtacccgttacgtacgtcccggtaccggttacgggacggttcgaacggggtaacttccgtcggttaccgtaccccggttcccttcccgtacccgtaccgtccccgtacccgaaccccggtaaaccgggccccgtaaccgttccccggttccccgtttccccccgtcgggtccccgtccccgtacgttcccgtccggacggtacgcccacccgttccgacggaacgacccgaacgaccgggcccggcccggttcgggccgttccggg

SEQ ID NO: 402825 - DNA, 596 bp, Homo sapiens
  misc_feature: GZ8MTXP02I2PF7.11.13.B02.1.454.CMB.2.raw
  modified_base (525)..(525): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaattgggtccgccaggctccgaggggaagggctgggagtgggtggccaacataaagccagatggaggtagtaaaacagtatgtagactctggtggagggccgttcaccatctccagagaacaacgccaaagaatgcgaatatatctaacagatagaaacagcctgccgagccgaggacacggcttgtgttattacgtgggtgggacgtcccgtggctggcctaccgtgtacgtcccggtacgttggacgtcgacgggtaactcgtcggtcctaccgttctaccctcgaccgcccgtaccaaccgacgggccctacgttcccggttcccttcccccgngcccgtcccgtcgcctccgaacggccgcccaacccgcgaacgcgccaacgcggccggcccgtgggctccgg

SEQ ID NO: 402826 - DNA, 530 bp, Homo sapiens
  misc_feature: GZ8MTXP02G89MT.11.13.B02.1.454.CMB.2.raw
tcagcgagagataccacgaccggtgctcgatttagtctagcgactttgggtctgggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgacgttggagtcagggactctggtcaccgtctcctcacgcctccaccaagggcccatccggtccttccccctggccgcccctgcctccaggacgccacctccgagacgcacacgccggccctgggcctgccgtcggtcaaggacctacttccgtactctctcgctgacgcggctcggcaaggcg

SEQ ID NO: 402827 - DNA, 544 bp, Homo sapiens
  misc_feature: GZ8MTXP02F0VFV.11.13.B02.1.454.CMB.2.raw
  modified_base (235)..(235): a, c, t, g, unknown or other
  modified_base (272)..(272): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggtccctgagactctcctgtacagcctctggattcagcatcagttcgtattggatgaattgggtccgccaggctccgagggaaggggctggagtgggtggccaanataaagccagatggagtgtaaaacagtatgtagactntgtggagggccggttcaccatctccagagacaacgccaaagaatgcgatatatctaacagatgaacagcctgccgagccgaggacacggctgtgtattactgtgggatccctgggctggcacctgtatccgaccgttggagtcgagggaactctggtcaccgtctcctcacgcctccaacccgaagggccccacgtccggtccttcccccgtcggcccgccccgtcgcctccaggacgccacctccgagaagcacacgccgcctcgggctcg

SEQ ID NO: 402828 - DNA, 549 bp, Homo sapiens
  misc_feature: GZ8MTXP02FR1MP.11.13.B02.1.454.CMB.2.raw
  modified_base (262)..(262): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctgggagtgggtggccaacataaagccagatggaggtgtaaaacngtatgtagactctgtggagggccggttcaccatctccagagacaacgccaaagaatgcgatatatctacagatgaacagcctgccgagccgaggacacggctgtgtattactgtgggatccctggctgcactgtatccgacgttggacgtcgagggaactctggtcaccgtctcctcacgccctaccacccaacgggcccagtccggtccttcccccgtggcccgccctcgcctcccgaggacgccaccctccgaacgaacgcacgacgccggcccgtcgggctcgg

SEQ ID NO: 402829 - DNA, 554 bp, Homo sapiens
  misc_feature: GZ8MTXP02GV9E0.11.13.B02.1.454.CMB.2.raw
  modified_base (262)..(262): a, c, t, g, unknown or other
  modified_base (386)..(386): a, c, t, g, unknown or other
  modified_base (493)..(493): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaacataaagtcagatggaggtgtaaaacngtatgtagactctgtggagggccggttcaccatctccagagacaacgccaaagaatgcgatatatctacagatggacagcctgccgagccgaggacacggctgtgtattactgtgggagtcccngggctggcaccgtgtactccgaccgttggagtcgagggaactcgtggtcaccggtctcctcacgcctccaccgaacgggcccagtccggtccttcccccgtggcccncccctgcctccgaggacgccacccgtccgagaacgccacgacgccggccctggggcctcgg

SEQ ID NO: 402830 - DNA, 549 bp, Homo sapiens
  misc_feature: GZ8MTXP02JRS4M.11.13.B02.1.454.CMB.2.raw
  modified_base (262)..(262): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacngtatgtagactctgtggagggccgttcaccatctccagagacaacgccaaagaatgcgatatatctacagatgaaacagcctgccgagccgaggacacggctgtgtattacgtggtggggatccccgtggctggcacctgtactcccgaccgttggagtcgagggactcgtggtcaccgtctccgtcacgccctccaccgaacgggcccagtccggtccttcccccgtggccgtccctgcctccgaggacgcacccgtccgagaacgcacgcgcggcccctggctcg

SEQ ID NO: 402831 - DNA, 580 bp, Homo sapiens
  misc_feature: GZ8MTXP02GQUSV.11.13.B02.1.454.CMB.2.raw
  modified_base (234)..(234): a, c, t, g, unknown or other
  modified_base (339)..(339): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggagggctggagtgggtggccaanataaagccagatggaggtgtaaaacagtatgtagactctgtggagggccgttcaccatctccagagacaacgccaaagaatgcgatatatctaacagatgaaacngcctgccgagccgaggacacggctgtgtattactggtgggagtccctgggctgcacctgtactccgaccgttggagtcgagggaactcgtcggtcaccgtctcctcacgccctaccacccgaaacgggccccctaagttcccggttcccttccccccgtgggcccgtccccgtcgcccgtccgaacggacgcccaacccgtccggacgaacgccaacgacgccggcccgtcggggcctcgg

SEQ ID NO: 402832 - DNA, 553 bp, Homo sapiens
  misc_feature: GZ8MTXP02H2MUQ.11.13.B02.1.454.CMB.2.raw
  modified_base (232)..(232): a, c, t, g, unknown or other
  modified_base (258)..(258): a, c, t, g, unknown or other
  modified_base (336)..(336): a, c, t, g, unknown or other
  modified_base (386)..(386): a, c, t, g, unknown or other
  modified_base (497)..(497): a, c, t, g, unknown or other
  modified_base (513)..(513): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggagggctggagtgggtgccaanataaagccagatggaggtgtaaaacngtatgtagactctggtggagggccgttcaccatctcagagacaacgccaaagaatgcgatatatctacagatgaaacngcctgccgagccgaggacacggctgtgtattactggtggggacttcccgnggcctggcaccgtgtactccgaccgttggagtcgagggaactcgtaggtcaccgtctccctcacgccctacccaccgaacgggcccagtccggtccttcccccgtggcccnccctgcctccacggcnccaccgtcgacgaacgcaacgcggccgcccgtggcctcgg

SEQ ID NO: 402833 - DNA, 590 bp, Homo sapiens
  misc_feature: GZ8MTXP02H9CJ7.11.13.B02.1.454.CMB.2.raw
  modified_base (265)..(265): a, c, t, g, unknown or other
  modified_base (344)..(344): a, c, t, g, unknown or other
  modified_base (378)..(378): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggagtgaattgggtccgccaggctccgaggggaaggggctgggagtgggtggccaacataaagccagatggaggtgtaaaacngtatgtagactctgtggagggccggttcaccatctccagagacaacgccaaagaatgcgatatatctacagatgaaacngcctgccgagccgaggacacggctgtgtattacnggtgggacgtccctggctgcacctgtactccggaccgtttgggactcgacggtactcgtcgtaccaccgttctcctcgacgtccctacccaaccgaacggccctagttcccgttcccgttcccccgcggccccgtcccgtcgccctacgacggacgacccgacccgtccgaagaaccgaccgaacgaccggcccggccccgtgggcctccgg

SEQ ID NO: 402834 - DNA, 530 bp, Homo sapiens
  misc_feature: GZ8MTXP02GRPOW.11.13.B02.1.454.CMB.2.raw
  modified_base (259)..(259): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggagtgtaaaacngtatgtagactctgtggaggccgttcaccatctccagagacaacgccaaagaatgcgatatatctacagatgaacagcctgccgagccgaggacacggctgtgtattacgtgtgggatccctgggctggcacctgtatccgaccgttggagtcgagggaactcgtcggtcaccgtctcctcacgcctccaccgaagggcccagtcggtcctccccgtgccgccctgctccaggcgccacctccgaagcgcacgacgccgccctcgggctcg

SEQ ID NO: 402835 - DNA, 573 bp, Homo sapiens
  misc_feature: GZ8MTXP02IEL6C.11.13.B02.1.454.CMB.2.raw
  modified_base (264)..(264): a, c, t, g, unknown or other
  modified_base (279)..(279): a, c, t, g, unknown or other
  modified_base (342)..(342): a, c, t, g, unknown or other
  modified_base (362)..(362): a, c, t, g, unknown or other
  modified_base (373)..(373): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaattgggtccgccaggctccgaggggaaggggctggagtgggtggccaacataaagccagatggaggtgtaaaacngtatgtagactctgnggagggccgttcaccatctccagagacaacgccaaagaatgcgatatatctacagatgaaacngctgccgagcgagacacggntgtgtattcgnggtggacgtcccgtgggctgcacgtgtactccgtacgttggagtacgagggactcgtcggtcctacccgtcctcctcacgtccctacccgaaccgacgggaccctacgtccggttcccttcccccgtcggcccgtcccgtcgcctccgacggacgccgacccgtccgacgaacgcacgacggccggcccgtcgggcctcg

SEQ ID NO: 402836 - DNA, 538 bp, Homo sapiens
  misc_feature: GZ8MTXP02GI9F6.11.13.B02.1.454.CMB.2.raw
  modified_base (529)..(529): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtatccgaccgttggagtcaggggactcgtggtccaccgtctcctcacgccctccacccaacgggcccatccggtcccttccccctggcccgccctcgcctccgaggacgccacctccgagacgcacacgccggcccgtggctcgccgtggtcaaggtctacttccgtactctctcgcgtgacgcggcncggcaggcg

SEQ ID NO: 402837 - DNA, 569 bp, Homo sapiens
  misc_feature: GZ8MTXP02IBRTO.11.13.B02.1.454.CMB.2.raw
  modified_base (275)..(275): a, c, t, g, unknown or other
  modified_base (279)..(279): a, c, t, g, unknown or other
  modified_base (333)..(333): a, c, t, g, unknown or other
  modified_base (376)..(376): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccaggggaagggctggagtgggtggccaacataaagccagatggaggtagtaaaacagtatgtagactntggnggagggccgtcaccatctccagagaccaacgccaaagaatgcgaatatatctanagatgaaacagcctgccgagccgagacacggctgtgtattacnggtggggacgtccctggcctcggcacctgtactcccggaccgttggagtcgaggggaactcgtggtccaccgttcctcctcagccctaccacccgaaacgggccccacgtccggtcccttcccccgtcgggccctcccgtcgcctccgacggacgccacctccgagaacgcacgacgccggccgtcggctcgg

SEQ ID NO: 402838 - DNA, 552 bp, Homo sapiens
  misc_feature: GZ8MTXP02FWLPG.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtactccgacgttggagtcagggactctggtccaccgtctcctcacgcctccaccaacgggcccagtcgtcctcccccgtggccgtccctgcctccaggacgccacccgtcccgagacgccacgacgccggccctggggcctcgcccgtggtacgaaacggaccttacttccgtactcctcttcgcttcggacgcgggctcggacaaggcg

SEQ ID NO: 402839 - DNA, 574 bp, Homo sapiens
  misc_feature: GZ8MTXP02I86RZ.11.13.B02.1.454.CMB.2.raw
  modified_base (198)..(198): a, c, t, g, unknown or other
  modified_base (235)..(235): a, c, t, g, unknown or other
  modified_base (261)..(261): a, c, t, g, unknown or other
  modified_base (296)..(296): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccnccaggctccgagggaagggctggagtgggtggccaanataaagtcagatggaggtgtaaaacngtatgtagactctggtggagggccgttcaccatcnccagagacaacgccaaagaatgcgaatatatctaacagatggacagcctgccgagccgaggacacggctgtgtattactggtgggatcccgtggctggcacctgtacgtccgaccgttgagtcgagggaactcgtggtccaccgtctcctcacgtccctaccaaccgaacgggcccctacgtccggtcccttcccccgtggcccgtcccgtgccctccgacggacgccgtacccgtccgaacgaacgccaaccgacggccggccccgtggggcctcgg

SEQ ID NO: 402840 - DNA, 557 bp, Homo sapiens
  misc_feature: GZ8MTXP02J2GJY.11.13.B02.1.454.CMB.2.raw
  modified_base (260)..(260): a, c, t, g, unknown or other
  modified_base (371)..(371): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggaggccggttcaccatctccagagacaacgccaaagaatgcgatatatctacagatgaacagcctgccgagccgaggacacggctgtgtattacngtgggatccctggctggcacctgtatccgacgttggagtcgagggactcgtgtccaccgtctcctcacgccctaccaccgaacgggccccagtccggtcccttcccccgtgggcccgtcccctggacctcccgaacggcgccacccgtcccgagaacgccaacgcggccggcccgtcggggctcgg

SEQ ID NO: 402841 - DNA, 535 bp, Homo sapiens
  misc_feature: GZ8MTXP02GVE81.11.13.B02.1.454.CMB.2.raw
tcagcgagagataccacgaccggtgctcgatttagtctagcgactttgggtctggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgcgagccgaggacacggctgtgtattactgtgggatccctggctggcacctgtatccgacgttggagtcaggggactctggtcaccgtctcctcacgccctccaccgaacgggcccagtccggtccttccccctcggccgcccctcgcctcccaggacgcacctccgagacgcgacagccggccgtggctcgcctggtcaaggactacttccgtactctctcgcgtgacgcgggctcggcgaaggcg

SEQ ID NO: 402842 - DNA, 559 bp, Homo sapiens
  misc_feature: GZ8MTXP02H276B.11.13.B02.1.454.CMB.2.raw
  modified_base (435)..(435): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctgggagtgggtggccaacataaaagccagatggaggtgtaaaacagtatgtagactctgtggagggccggttcaccatctccagagacaagccaaagaatgcgatatatctaacagatgaaacagcctgccgagccgaggacacggctgtgtattactgtggggagtccctggcctggcacctgtatccgaccgttgagtcagggaactcgtggaccncgtctctcacgcccaccaccgaacggccctacgtccgtcccttcccccgtcggcccgtcccgtcgccgaccgacggacgaccgaccgaccgacgaacgacacgacgccggcccggtcggcgtcg

SEQ ID NO: 402843 - DNA, 562 bp, Homo sapiens
  misc_feature: GZ8MTXP02FYJRO.11.13.B02.1.454.CMB.2.raw
tcagcgagagataccacgaccggtgctcgatttagtctagcgactttgggttctccttgttgctattttagaaggtgtccagtgtgaggcgcagatgggtggggtcgtgggggaggcttggtccagccgtggggggtccctgagactctcctgtacagcctctggattcagcatcagttcgtattggatgaattgggtccgccaggctccgagggaaggggctggagtgggtggccaacataaagccagatggaggtgtaaaacagtatgtagactctgtggagggccggttcaccatctccagagacaacgccaaagaatgcgatatatctacagatgaaacagcctgccgagccgaggacacggctgtgtattactgtggggatcccgtggctggcaccctgtactcccgaccgttggagtcgagggaactcgtggtcaccgtctcctcacgccctccacccgaagggcccagtccggtccttcccccgtggccgcccctgcctccgaggacgccaacccgtccgagaacgccaacgacggccggcccgtcggggctcgg

SEQ ID NO: 402844 - DNA, 571 bp, Homo sapiens
  misc_feature: GZ8MTXP02JO9ZT.11.13.B02.1.454.CMB.2.raw
  modified_base (265)..(265): a, c, t, g, unknown or other
  modified_base (342)..(342): a, c, t, g, unknown or other
  modified_base (458)..(458): a, c, t, g, unknown or other
  modified_base (509)..(509): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctggggggtccctgagactctcctgtacagcctctggattcagcatcagttcgtattggatgaattgggtccgccaggctccgagggaagggctgggagtgggtggccaacataaagccagatgggaggtagtaaaacngtatgtagactctgtggagggccgttcaccatctccagagacaacgccaaagaatgcatatatctacagatgaaacngcctgccgagccgagacacggctgtgtattacgtggtggggactcccgtggctggccaccgtgtactcccggacgttggacgtcgagggtaactcgtcggtccaccgtctcccgtnacgtcccctaccgaacccgaacgggcccctagtccggttcccttcccccgnggcccgtcccctggaccctccgaggacgccacctccgagcgcacgcgtcgcccgtgggctcg

SEQ ID NO: 402845 - DNA, 559 bp, Homo sapiens
  misc_feature: GZ8MTXP02GZJXO.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacagtatgtagactctgtggagggccggttcaccatctccagagacaacgccaaagaatgcgatatatctacagatgaaacagcctgccgagccgaggacacggctgtgtattactggtgggatccctggctggcaccgtgtactccgaccgttggagtcgagggaactcgtcggtcaccgtctcctcacgccctccaaccgaacgggccccagtcccggtccttcccccgtggcccgtccctcgcctccgaggacgccacccgtccgagaacgccacgacgccggcccctgggcctcgg

SEQ ID NO: 402846 - DNA, 538 bp, Homo sapiens
  misc_feature: GZ8MTXP02GYXLE.11.13.B02.1.454.CMB.2.raw
  modified_base (503)..(503): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaaacagcctgccgagccgaggacacggctgtgtattactggtgggagtccctggctggcacctgtactccgaccgttggagtcagggaactcgtggtcaccgtctcctcacgcctccaccaacgggcccatccggtccttcccccgtcggccgccctgcctccaggcnccacctcgacgcgcacgacgccgccctcgggctcg

SEQ ID NO: 402847 - DNA, 573 bp, Homo sapiens
  misc_feature: GZ8MTXP02I7GK7.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgccgagccgaggacacggctgtgtattactgtgggagtccctggctggcacctgtactccgaccgttggagtcagggaactctggtcaccggtctccctcacgccctccacccgaaggggccccaagttccggtccctttccccccgtgggcccgtccccgttggcctacccgagggacgccgaaccctccggagaacgccacgacggcccggccccgtggggcctccgg

SEQ ID NO: 402848 - DNA, 547 bp, Homo sapiens
  misc_feature: GZ8MTXP02HPOFU.11.13.B02.1.454.CMB.2.raw
  modified_base (263)..(263): a, c, t, g, unknown or other
  modified_base (374)..(374): a, c, t, g, unknown or other
  modified_base (507)..(507): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagtcagatggaggtgtaaaacngtatgtagactctgtggagggccggttcaccatctccagagacaacgccaaagatgcgatatatctacagatggacagcctgccgagccgaggacacggctgtgtattacngtgggactccctggctggcacctgtactccgacgttggagtcgagggactcgtcggtcaccgtctcctcacgccctccaccgaacgggcccagtccggtccttcccccgtggcccgccctgcctccgaggacnccacctccgagaacgcacgacgccggcccgtcgggctcgg

SEQ ID NO: 402849 - DNA, 552 bp, Homo sapiens
  misc_feature: GZ8MTXP02GXVGU.11.13.B02.1.454.CMB.2.raw
tcagcgagagataccacgaccggtgctcgatttagtctagcgactttgggtctgggggaggcttggtccagtctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgagacacggctgtgtattactggtgggacgtccctggctggcacctgtactccgacgttggagtcagggactctggtccaccgtctcctcacgccctccaccaacgggcccatccggtcccttcccccgtcggccgccctgcctccgaggacgcaccgtccgagacgccacacggccggcccgtcgggctcgcccgtggtccgaaaggtacctacgttccgtactcctctcgcgtgacggcggctcggcgaaggcg

SEQ ID NO: 402850 - DNA, 554 bp, Homo sapiens
  misc_feature: GZ8MTXP02JG2HF.11.13.B02.1.454.CMB.2.raw
  modified_base (261)..(261): a, c, t, g, unknown or other
  modified_base (296)..(296): a, c, t, g, unknown or other
  modified_base (341)..(341): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatcnccagagacaacgccaaagaatgcgatatatctaacagatgaaacngcctgccgagccgaggacacggctgtgtattactgtgggatccctggctggcacctgtatccgaccgttggagtcagggaactcgtggtcaccgtctccgtcacgccctaccaccgaacgggcccagtccggtccttcccccgtggccgcccctggcctcccgacggacgccaacctcccgagaacgcgacacggccggccctggggcctcgg

SEQ ID NO: 402851 - DNA, 553 bp, Homo sapiens
  misc_feature: GZ8MTXP02G2XZ4.11.13.B02.1.454.CMB.2.raw
  modified_base (263)..(263): a, c, t, g, unknown or other
  modified_base (343)..(343): a, c, t, g, unknown or other
  modified_base (392)..(392): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggaggtgtaaaacngtatgtagactctggtggagggccggttcaccatctccagagacaacgccaaagaatgcgatatatctacagatgaaacngcctgccgagccgaggacacggctgtgtattacgtggtgggactcccgnggctgcacctgtacgtccgaccgttggacgtcgagggactcgtcgtcaccgtctcctcacgcctaccaccgaacggcccacgtccggtccttcccccgtgcccgccctcgcctccgaggacgccaccgtcgagaacgcacgacgccggccgtcgggctcgg

SEQ ID NO: 402852 - DNA, 563 bp, Homo sapiens
  misc_feature: GZ8MTXP02FYYBE.11.13.B02.1.454.CMB.2.raw
  modified_base (236)..(236): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaanataaagccagatggaggtgtaaaacagtatgtagactctgtggagggccgttcaccatctcagagacaacgccaagaatgcgatatatctacagatgaaacagcctgccgagccgagacacggctgtgtattactggtgggacgtccctgggctggcacctgtactccgacgttggagtcgagggaactcgtggtccaccgtctccctcacgccctaccaaccgaacgggcccacgtccggtcccttcccccgtggcccgccctgacctcccgaggacgcccaacccgtccgagaacgccaacgacggccggcccgtggggcctcgg

SEQ ID NO: 402853 - DNA, 567 bp, Homo sapiens
  misc_feature: GZ8MTXP02JVHTN.11.13.B02.1.454.CMB.2.raw
  modified_base (494)..(494): a, c, t, g, unknown or other
tcagcgagagataccacgaccggtgctcgatttagtctagcgactttgggttctccttgttgctattttagtaaggtgtccagtgtgaggcgcagatggtggggtcgtgggggaggcttggtccagcctggggggtccctgagactctcctgtacagcctctggattcagcatcagttcgtattggatgaattgggtccgccaggctccaggggaaggggctggagtgggtggccaacataaagccagatggaggtagtaaaacagtatgtagactctgtggagggccggttcaccatctccagagacaacgccaagaatgcgatatatctacagatgaaacagcctgccgagccgaggacaggctgtgtattacgtgtggggatccctggctggcacctgtactccgaccgttggagtcgagggaactcgtgtcgacccgtctccctcacgccctcccaccgaacggggcccacgtccggtcccttcccccgnggcccgccctcgcctccgacggacgcccacccgtccgaggaacgccgaacgacgccggcccgtcgggctccgg

SEQ ID NO: 402854 - DNA, 549 bp, Homo sapiens
  misc_feature: GZ8MTXP02H7XL7.11.13.B02.1.454.CMB.2.raw
  modified_base (263)..(263): a, c, t, g, unknown or other
  modified_base (376)..(376): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggaggtgtaaaacngtatgtagactctgtggagggccggttcaccatctccagagacaacgccaaagaatgcgatatatctacagatgaaacagcctgccgagccgagacacggcttgtgtattacngtgggatccctggctggcacctgtactcccgaccgttggagtcgaggggaactcgtggtcaccgtctctcacgccctcacccaaggcccagtccggtcctccccgtggcccgccctgcctccacggacgccaccctccgagaacgccacgacggccggccccgtgggcctcgg

SEQ ID NO: 402855 - DNA, 552 bp, Homo sapiens
  misc_feature: GZ8MTXP02HENZP.11.13.B02.1.454.CMB.2.raw
  modified_base (262)..(262): a, c, t, g, unknown or other
  modified_base (488)..(488): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtggccaacataaagccagatggaggtgtaaaacngtatgtagactctgtggagggccgttcaccatctccagagacaacgccaaagaatgcgatatatctacagatgaaacagcctgccgagccgagacacggctgtgtattactgtgggagtccctgggctggcacctgtactccgaccgttggacgtcgagggaactcgtggtccaccgtctcctcacgcctccaaccgaacgggcccacgtccggtccttcccccgnggcccgccctcgcctccgacggacgccaccctccgacgaacgcacacggccgcccgtcggctcg

SEQ ID NO: 402856 - DNA, 513 bp, Homo sapiens
  misc_feature: GZ8MTXP02JE1MD.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtatccgacgttggagtcagggactctggtcaccgtctctcagcctccaccaagggcccatcgtctccccctgccgccctgctccaggacgcacctccgagacgcacacgcggcctgggctgcctggtcaaggctacttccgtatctctcgctgacgcgggctcggcaaggcg

SEQ ID NO: 402857 - DNA, 547 bp, Homo sapiens
  misc_feature: GZ8MTXP02IVFQF.11.13.B02.1.454.CMB.2.raw
  modified_base (262)..(262): a, c, t, g, unknown or other
  modified_base (374)..(374): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctgggagtgggtggccaacataaagccagatggaggtgtaaaacngtatgtagactctgtggagggccggttcaccatctccagagacaacgccaaagaatgcgatatatctacagatgaacagcctgccgagccgaggacacggctgtgtattacngtgggagtccctggctgcactgtactccgaccgttggagtcgagggactcgtggtcaccgtctcctcacgcctccaccaacgggcccacgtccggtccttcccccgtcggcccgccctcgcctccgacggacgccaccgtccgagaacgcacgacgccggccctcgggctcgg

SEQ ID NO: 402858 - DNA, 574 bp, Homo sapiens
  misc_feature: GZ8MTXP02F2IQO.11.13.B02.1.454.CMB.2.raw
  modified_base (263)..(263): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggaggtgtaaaacngtatgtagactctgtggagggccggttcaccatctccagagacaacgccaaagaatgcgatatatctacagatgaaacagcctgccgagccgaggacacggctgtgtattacgtggtggggatcccgtgggcctgggcacctgtactccggaccgttggagtcgagggaactcgtggtccaccgtctcctcacgcctcccaccgaacgggcccacgttccggtccttcccccgtcggccgccccgtcgcctacccgacggacggccacccgtccggacgaacgcacgacggccggcccgtcggggcctcgg

SEQ ID NO: 402859 - DNA, 563 bp, Homo sapiens
  misc_feature: GZ8MTXP02ID1F2.11.13.B02.1.454.CMB.2.raw
  modified_base (262)..(262): a, c, t, g, unknown or other
  modified_base (520)..(520): a, c, t, g, unknown or other
  modified_base (543)..(543): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccggttcaccatctccagagacaacgccaaagaatgcgatatatctacagatgaaacagcctgccgagccgaggacacggctgtgtattactggtgggatccctggcctggcacgtgtactcccgtaccgttggagtcgaaggggaactcgtcggtccaccgtctcctcacgccctccaccgaacgggcccagtccggtccttcccccgtggcccgccctcgcctcccgacgggacnccacccgtccgacgaacgcaacncggccgcccgtcgggctcgg

SEQ ID NO: 402860 - DNA, 602 bp, Homo sapiens
  misc_feature: GZ8MTXP02IHXOX.11.13.B02.1.454.CMB.2.raw
  modified_base (265)..(265): a, c, t, g, unknown or other
  modified_base (344)..(344): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagccgtgggggggtccctgagactctcctgtacagcctctggattcagcatcagttcgtattggatgaattgggtccgccaggctccgaggggaagggctggagtgggtgccaacataaagccagatggaggtagtaaaacngtatgtagactctggtggagggccgttcaccatctccagagacaacgcaaagaatgacgatatatctacagatgaaacngcctgccgagccgaggacacggctgtgtattacgtggtgggacgtcccgtggctcggcacctgtacgtccgaccgttggacgtacgacggaactcgtcgtccgacccgtcctcctcacgccctacccgaacccgaacgggccctacgttcccggttcccttcccccgtcggtcccgccccgttcgcccgtccgaacgggaccgacccgacccgtccgacgaacgaccaaccgcggcccgggcccgtcgggccgtccgg

SEQ ID NO: 402861 - DNA, 538 bp, Homo sapiens
  misc_feature: GZ8MTXP02HR6AX.11.13.B02.1.454.CMB.2.raw
  modified_base (235)..(235): a, c, t, g, unknown or other
  modified_base (261)..(261): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaanataaagccagatggaggtgtaaaacngtatgtagactctgtggagggccgttcaccatctccagagacaacgccaaagaatgcgatatatctacagatgaacagcctgccgagccgagacacggctgtgtattactgtgggatccctggctgcactgtatccgaccgttgagtcgagggactctgtcaccgtctcctcacgcctccaccaacgggcccagtccggtccttcccccgtcggccgccctcgcctccgacggacgccacctcccgagaacgcacgacgccggcccgtcgggctcgg

SEQ ID NO: 402862 - DNA, 651 bp, Homo sapiens
  misc_feature: GZ8MTXP02GT76V.11.13.B02.1.454.CMB.2.raw
  modified_base (379)..(379): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacagtatgtagactctggtggagggccggttcaccatctccagagacaacgcaaagatgcgatatatctacagatgaaacagcctgccgagccgaggacacggctgtgtattacgnggtggggacgtccctgggctgggcctaccgtgtactcccggaccggtttgggacgtcgaacgggtactcgtcggtacctacccgtcctcccgtacgaccgtccctacccgaaccggaaccgggtccctacggtttccccgggttccccctttcccccggtcggggcccccgtccccgttcggcccctaccggaacggggaccaccccgtacccgtaccggaagaaccgccgaaccggtccgggccccggtcccggttcggggccttcccggg

SEQ ID NO: 402863 - DNA, 555 bp, Homo sapiens
  misc_feature: GZ8MTXP02HJX97.11.13.B02.1.454.CMB.2.raw
  modified_base (261)..(261): a, c, t, g, unknown or other
  modified_base (373)..(373): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaagggctggagtgggtggccaacataaagccagatggaggtgtaaaacngtatgtagactctgtggagggccgttcaccatctccagagacaacgccaaagaatgcgatatatctacagatgaaacagcctgccgagccgaggacacggctgtgtattacngtgggagtccctggctgcacctgtatccgaccgttggagtcgagggaactcgtcggtcaccgtctcctcacgcctaccaccgaacggcccacgtccggtccttcccccgtggcccgtccctcggcctccgacgggacgccgacctccgagaacgcaccgacggccggcccgtcgggcctcgg

SEQ ID NO: 402864 - DNA, 573 bp, Homo sapiens
  misc_feature: GZ8MTXP02GSD3B.11.13.B02.1.454.CMB.2.raw
  modified_base (330)..(330): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctanagatgaaacagcctgccgagccgaggacacggctgtgtattactggtgggactcccgtggctggcaccgtgtactccgtaccgttggacgtcgagggaactcgtcggtcaccgtcctcctcacgtccctccaacccgaacgggcccagtccggtccttcccccgtcggccgcccctgccctcccgacggacgcccgaaccgtccgacgaacgaccgacgacggccggcccgtcggggctccgg

SEQ ID NO: 402865 - DNA, 570 bp, Homo sapiens
  misc_feature: GZ8MTXP02FXZRL.11.13.B02.1.454.CMB.2.raw
  modified_base (263)..(263): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctgggagtgggtggccaacataaagccagatggaggtgtaaaacngtatgtagactctggtggagggccggttcaccatctccagagacaacgccaaagaatgcgatatatctacagatgaaacagcctgccgagccgaggacacggctgtgtattacgtggtgggactcccgtggctggcacctgtactccgacgttggagtcgagggactcgtggtccaccgtctccctcacgccctaccaacccgaacgggccccagttccggtcccttccccccgtggcccgcccctcgcctcccgaggacgccaaccctccggagaacgccacgacggccggcccgtcggggctcgg

SEQ ID NO: 402866 - DNA, 551 bp, Homo sapiens
  misc_feature: GZ8MTXP02GNQ55.11.13.B02.1.454.CMB.2.raw
  modified_base (263)..(263): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctggagtgggtggccaaacataaagccagatggaggtgtaaaacngtatgtagactctgtggagggccggttcaccatctccagagacaacgccaaagaatgcgatatatctacagatgaaacagcctgcgagccgaggacacggctgtgtattactgtggggactcccgtggctggcacctgtactccgaccgttggagtcgagggaactcgtgtcaccgtctcctcacgcctccaccgaacggcccacgtcgtccttccccgtcggccgccctcgcctccgacggacgccacccgtccgacgaacgcacgacgccggcccgtcgggctcgg

SEQ ID NO: 402867 - DNA, 603 bp, Homo sapiens
  misc_feature: GZ8MTXP02GA1TV.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaaggcacggctgtgtattactggtgggacgtcccgtggctggcacctgtactcccgacgttggagtcgagggactcgtggtcacccgtctcctcacgccctccaccgaacgggcccacgtcccggttccctcccccgtcggcccgccctcgcctccgaggacgccacccgtcccggagacgaccacgacgccggtccccgtgggcctcggcccgtcgggtaccgtaaacgggtacccttaaccgtttccggttacttccgttccgtccggcgttcggacggccggggcgtcgggacgaacgggccg

SEQ ID NO: 402868 - DNA, 532 bp, Homo sapiens
  misc_feature: GZ8MTXP02I3MJ6.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaaacagcctgccgagccgaggacacggctgtgtattactgtggggatccctggctggcacctgtactccgaccgttggagtcagggaactctggtcaccgtctcctcacgcctccaccaacgggcccatcggtcctcccctggccgccctgcctccacggacgcacctccgagaacgcacacgcggccctgggctcg

SEQ ID NO: 402869 - DNA, 546 bp, Homo sapiens
  misc_feature: GZ8MTXP02GH4HD.11.13.B02.1.454.CMB.2.raw
  modified_base (259)..(259): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggagtgtaaaacngtatgtagactctgtggagggccggttcaccatctccagagacaacgccaagaatgcgatatatctacagatgaaacagcctgccgagccgaggacacggcttgtgtattactgtgggatccctggctgcacctgtatccgacgtggagtcgaggggaactcgtggtcaccgtctcctcacgccctaccacccaacgggcccagtccggtccttcccccgtggcccgccctcgcctacccgacggacgccacctccgagaacgcacgacgccggcccgtcggctcgg

SEQ ID NO: 402870 - DNA, 547 bp, Homo sapiens
  misc_feature: GZ8MTXP02HMGMG.11.13.B02.1.454.CMB.2.raw
  modified_base (266)..(266): a, c, t, g, unknown or other
  modified_base (283)..(283): a, c, t, g, unknown or other
  modified_base (338)..(338): a, c, t, g, unknown or other
  modified_base (488)..(488): a, c, t, g, unknown or other
  modified_base (497)..(497): a, c, t, g, unknown or other
  modified_base (515)..(515): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacngtatgtagactcgtggnggagggccggttcaccatctccagagaacaacgccaaagatgcgaatatatctanagatgaaacagcctgccgagccgaggacacggctgtgtattactggtgggacgtccctggcgtcgcacgtgtactccgacgttggagtcgaggactgtcgtcaccgtctcctcacgcctaccacgaacggcccagtccggtcctccccgngcccgtccncgcctaccgacgggaccnccaccgcgacgcgcacgcgccgccgcggctcg

SEQ ID NO: 402871 - DNA, 558 bp, Homo sapiens
  misc_feature: GZ8MTXP02H0SR9.11.13.B02.1.454.CMB.2.raw
  modified_base (261)..(261): a, c, t, g, unknown or other
  modified_base (376)..(376): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaagggctggagtgggtggccaacataaagccagatggaggtgtaaaacngtatgtagactctgtggagggccgttcaccatctccagagacaacgccaaagaatgacgatatatctacagatgaaacagcctgccgagccgatgacacggctggtgtattacgngtggggactccctggctggctacctgtactcccgaccgttggagtcgagggactcgtggtcaccgtctcctcagccctccaccgaacgggcccagtccggtccttcccccgtggccgccctgcctaccgacggacgccaacccgtccgaagacgaccacgacggcccggcccgtggggcccg

SEQ ID NO: 402872 - DNA, 566 bp, Homo sapiens
  misc_feature: GZ8MTXP02GF6S8.11.13.B02.1.454.CMB.2.raw
  modified_base (263)..(263): a, c, t, g, unknown or other
  modified_base (342)..(342): a, c, t, g, unknown or other
  modified_base (493)..(493): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggaggtgtaaaacngtatgtagactctgtggagggccggttcaccatctccagagacaacgccaaagaatgcgatatatctacagatgaaacngcctgccgagccgaggacacggctgtgtattacgtggtgggacgtccctgggctggcacctgtactccgaccgttggacgtcgagggactcgtcggtcaccgtctcctcacgccctccaccgaacgggcccagtccggtcccttcccccgngggcccgccctcggcctccgacggacgccacccgtcgagaacgccgaacgcggccggcccgtcgggactccgg

SEQ ID NO: 402873 - DNA, 609 bp, Homo sapiens
  misc_feature: GZ8MTXP02HE1GP.11.13.B02.1.454.CMB.2.raw
  modified_base (350)..(350): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactcgtggtggagggccggttcaccatctccagagacaacgccaaagaatgacgatatatctacagatgaaacngcctgccgagccgagacacggctgtgtattacgtggtaggggacgtcccgtgggcgtcgggcctacctggtacgtcccggtaaccggttggacgtcgaacggggaactcgtcggtccgaccgttctcctcacgccctaccaccgaacggcccacgttccggtcccttcccccgtggcccgtcccgtcgcctccgacggacgaccgacccgtccggaacgaacgaccgaccgacggcccggtcccggtcgggtcctccgg

SEQ ID NO: 402874 - DNA, 567 bp, Homo sapiens
  misc_feature: GZ8MTXP02HAH3Q.11.13.B02.1.454.CMB.2.raw
  modified_base (338)..(338): a, c, t, g, unknown or other
  modified_base (373)..(373): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccgttcaccatctccagagacaacgccaaagaatgcgatatatctacagatgaaacngcctgccgagccgaggacacggctgtgtattacgnggtgggacgtccctgggctggcaccgtgtacgtccgaccgttggacgtcgagggaactcgtggtccaccgtctcctcacgcctccaccgaacgggccctagtccggtcccttccccgtcggcccgtccctcggcctacccgaggaccgccgacccgtcgacgcgcgacgaccggccggcccgtcggggctccgg

SEQ ID NO: 402875 - DNA, 574 bp, Homo sapiens
  misc_feature: GZ8MTXP02HYKZ9.11.13.B02.1.454.CMB.2.raw
  modified_base (239)..(239): a, c, t, g, unknown or other
  modified_base (274)..(274): a, c, t, g, unknown or other
  modified_base (339)..(339): a, c, t, g, unknown or other
  modified_base (349)..(349): a, c, t, g, unknown or other
  modified_base (398)..(398): a, c, t, g, unknown or other
  modified_base (509)..(509): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaagggctggagtgggtgccaanataaagccagatggaggtagtaaaacagtatgtanactcgtggtggaggggccgttcaccatcctccagagaaccaacgccaaagatgcgatatatctanagatagaacngcctgccgagccgaggcacggctgtgtattacgtggtggggactcccgnggctcggcacgtgtactccggaccgttggagtcgaggactcgtgctaccgtctcctcacgccctaccgaccgaacgggccccacgttccggtcccttcccccgtcggcccnccctcggcctccgaacggcgacccaccgtccgagaacgcacgacgcccggcctcggggcctccgg

SEQ ID NO: 402876 - DNA, 543 bp, Homo sapiens
  misc_feature: GZ8MTXP02IGSYT.11.13.B02.1.454.CMB.2.raw
  modified_base (511)..(511): a, c, t, g, unknown or other
tcagcgagagataccacgaccggtgctcgatttagtctagcgactttgggttctccttgttgctattttagaaggtgtccagtgtgaggcgcagatggtggggtcgtggggggaggcttggtccagcctggggggtccctgagactctcctgtacagcctctggattcagcatcagttcgtattggatgaattgggtccgccaggctccgaggggaaggggctggaaaggtgggtggccaacataaagccagatggaggtagtaaaacagtatgtagactctgtggagggccggttcaccatctccagagacaacgcccaaagaatgcgatatatctacagatgaacagcctgccgagccgagacacggctgtgtattactggtgggagtccctggctgggcacctgtatcccgacgttggagtcaggggaactctggtcaccgtctcctcacgcctccaccgaacggcccatccggtcttccccctggccgccctgcctccagggacccnccacctcgagcgcacgcgccgccgtcggctcg

SEQ ID NO: 402877 - DNA, 604 bp, Homo sapiens
  misc_feature: GZ8MTXP02FMLOC.11.13.B02.1.454.CMB.2.raw
  modified_base (269)..(269): a, c, t, g, unknown or other
  modified_base (553)..(553): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaacataaaagccagatgggaggtagtaaaacngtatgtagactctgtgggagggccgttcaccatctccagagacaacgccaaagaatgacgatatatctaacagatgaacagcctggccgagccgaggacacggctgtgtattacgtggtggggactcccgtgggctgggcctaccgtgtacgtccgaccgttggacgtacgagggaactcgtggtaccacccgtctccctcacgccctaccgaacccgaacgggcccccacgttcccggttccccttcccccgtcgggccctcccgtcggcctcccgaggaccncccacccgtcgaacggaacgccgaacgcggcccggtcccgtgggcctccgg

SEQ ID NO: 402878 - DNA, 556 bp, Homo sapiens
  misc_feature: GZ8MTXP02F91UF.11.13.B02.1.454.CMB.2.raw
  modified_base (233)..(233): a, c, t, g, unknown or other
  modified_base (259)..(259): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggagggctggagtgggtggccaanataaagccagatggaggtgtaaaacngtatgtagactctgtggagggccggttcaccatctccagagacaacgccaaagaatgcgatatatctaacagatgaacagcctgccgagccgaggacacggctgtgtattacgtgtgggatcccgtggctggcacctgtactccgaccgttggagtcagggaactcgtggtctaccgtctcctcacgcctccacccgaacgggcccacgtccggtccttcccccgtcggccgcccgtcgcctccgacggacgccacccgtccgacgaacgcacgacgccggcccgtcggggcctcgg

SEQ ID NO: 402879 - DNA, 590 bp, Homo sapiens
  misc_feature: GZ8MTXP02JW3FJ.11.13.B02.1.454.CMB.2.raw
  modified_base (262)..(262): a, c, t, g, unknown or other
  modified_base (302)..(302): a, c, t, g, unknown or other
  modified_base (468)..(468): a, c, t, g, unknown or other
  modified_base (540)..(540): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtggccaacataaagccagatggaggtgtaaaacngtatgtagactctgtggagggccgttcaccatctccaganacaacgccaagaatgcgatatatctacagatagaacagcctgccgagccgaggacacggctgtgtattacgtggtggggacgtcccgtgggcgtcgggctacccgtgtactcccggtacccggtttggacgttcgaacgggtaactcgtacggtcaccgtcctccncacgcctaccgaccgaacgggcccagtccgtcccttccccgtggcccgtcccgtcgccgtccgacgggaccnccacccgtcccgagaacgcgaaccgcggtccggcccgtcggggcctccgg

SEQ ID NO: 402880 - DNA, 578 bp, Homo sapiens
  misc_feature: GZ8MTXP02JYQWQ.11.13.B02.1.454.CMB.2.raw
  modified_base (265)..(265): a, c, t, g, unknown or other
  modified_base (334)..(334): a, c, t, g, unknown or other
  modified_base (532)..(532): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacngtatgtagactctggtggagggccggttcaccatctccagagacaacgcaaagaatgcgatatatctanagatgaaacagcctgccgagccgaggacacggctgtgtattacgtggtgggacgtcccgtgggctggcacgtgtactcccgaccgttggagtcgaagggtaactcgtaggtcaccgtctcctcacgccctcccgaaccgaacgggccccagtcccggttcccttcccccgtggcccgtcccctgcctccgacgggacnccacccgtccgacgaacgccaacgcggccggcccgtcgggcgtcgg

SEQ ID NO: 402881 - DNA, 562 bp, Homo sapiens
  misc_feature: GZ8MTXP02G4U6B.11.13.B02.1.454.CMB.2.raw
  modified_base (262)..(262): a, c, t, g, unknown or other
  modified_base (344)..(344): a, c, t, g, unknown or other
  modified_base (393)..(393): a, c, t, g, unknown or other
  modified_base (499)..(499): a, c, t, g, unknown or other
  modified_base (505)..(505): a, c, t, g, unknown or other
  modified_base (524)..(524): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctggggggtccctgagactctcctgtacagcctctggattcagcatcagttcgtattggatgaattgggtccgccaggctccgagggaagggctggagtgggtgccaacataaagccagatggaggtagtaaaacngtatgtagactctgtggagggccggttcaccatcctccgagagaccaacgccaaagaatgcgatatatctacagatgaaacngcctgccgagccgaggacacggctgtgtattacgtggtgggactcccgnggctggctaccgtgtactccgaccgttggacgtcgaagggtacctcgtcgtaccaccgttctcctcacgccctaccaccgacggcccacgtccgtcccttccccgnggcccncctcgcctccgagggaccnccgaccgcgacgcgcgacgcggccggccgtcggcgtcg

SEQ ID NO: 402882 - DNA, 578 bp, Homo sapiens
  misc_feature: GZ8MTXP02HDFTD.11.13.B02.1.454.CMB.2.raw
  modified_base (262)..(262): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacngtatgtagactctgtggagggccggttcaccatctccagagacaacgcaagaatgcgatatatctacagatgaaacagcctgccgagccgaggacacggctgtgtattactggtgggacgtcccgtgggctgggcacccgtgtacgtccgaccgttggacgtcgaaggggtaactcgtggtccaccgttctcctcacgcctaccaccgaacgggcccacgtccggtcccttcccccgtcggcccgtcccgtcgcctcccgacggaccgaccacccgtcgacgaacgcgaacgcggccggccccgtcggggctccgg

SEQ ID NO: 402883 - DNA, 576 bp, Homo sapiens
  misc_feature: GZ8MTXP02H5DT7.11.13.B02.1.454.CMB.2.raw
  modified_base (267)..(267): a, c, t, g, unknown or other
  modified_base (346)..(346): a, c, t, g, unknown or other
  modified_base (365)..(365): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccaggggaaggggctgggagtgggtggccaaacataaagccagatggaggtgtaaaacngtatgtagactctgtggagggccggttcaccatctccagagacaacgccaaagaatgcgatatatctacagatgaaacngcctgccgagccgaggacncggctgtgtattactggtgggactcccgtggctggcactgtatccgacgtttggacgtcagggaactgtggtcaccgtctcctcacgccctaccgaaccgaaacggggcccctaagtccgggttcccttcccccgtggcccgtccctcgccctccgacggacgccgacccgtccggagaacgcaacgacggtccggcccgtcgggctacgg

SEQ ID NO: 402884 - DNA, 653 bp, Homo sapiens
  misc_feature: GZ8MTXP02HW0GK.11.13.B02.1.454.CMB.2.raw
  modified_base (274)..(274): a, c, t, g, unknown or other
  modified_base (283)..(283): a, c, t, g, unknown or other
  modified_base (302)..(302): a, c, t, g, unknown or other
  modified_base (307)..(307): a, c, t, g, unknown or other
  modified_base (321)..(321): a, c, t, g, unknown or other
  modified_base (336)..(336): a, c, t, g, unknown or other
  modified_base (403)..(403): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaagggctgggagtgggtggccaacataaagccagagtgggaggtataaacagtatgtanactcgtggnggacgggtccgtcacatcncaganacaacgacaaagangacatatatactaanagtatagaacacgctgaccgacgccgaggacgacggtctgtgtattacgtggtcgggtacgtcccgngtccgtgacctacgtgtacgtcccggtacggttgacgtacgaacgggtacctcgtacggtaccctaccgttcctcccgtacgacccgtccctaccccgaaaccggaaccgggcccctacgttccccggttcccctcccccggtcggaccccgttccctacggtcccaaccggagggtacccaccctacccggtccgaagaacccgaccgaccggccggggccccggtcccggtcgggggtccctcccggg

SEQ ID NO: 402885 - DNA, 569 bp, Homo sapiens
  misc_feature: GZ8MTXP02I1RRP.11.13.B02.1.454.CMB.2.raw
  modified_base (346)..(346): a, c, t, g, unknown or other
  modified_base (523)..(523): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagtcagatggaggtagtaaaacagtatgtagactctggtggagggccggttcaccatcctccagagacaacgccaaagaatgcgatatatctaacagatgaaacngcctgccgagccgagacacggcttgtgtattacgtgtgggacgtccctgggctggcaccgtgtactccgaccgttggacgtcgaaggggactgtcggtccaccgttctcctcacgcctccaccgacgggcccagtccggtccttcccccgtggcccgtccctcgcctccgaggaccnccgacccgtccgacgaacgccacgacggccggcccgtcgggctcgg

SEQ ID NO: 402886 - DNA, 572 bp, Homo sapiens
  misc_feature: GZ8MTXP02GZNIO.11.13.B02.1.454.CMB.2.raw
  modified_base (264)..(264): a, c, t, g, unknown or other
  modified_base (376)..(376): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtgtaaaacngtatgtagactctgtggagggccgttcaccatctccagagacaacgccaaagaatgcgatatatctacagatgaaacagcctgccgagccgagacacggctgtgtattacgnggtggactccctggctgctactgtactccgacgttggagtcgaggaactcgtcggtcaccgtctcctcacgccctccaaccgacggcccagtcccggttcctcccccgtggcccgtccccgtcgcctaccgacggaccgccgacccgtccgaacgaacggccaaccgacggcccggtccccgtcggggccttccgg

SEQ ID NO: 402887 - DNA, 577 bp, Homo sapiens
  misc_feature: GZ8MTXP02HUZMJ.11.13.B02.1.454.CMB.2.raw
  modified_base (236)..(236): a, c, t, g, unknown or other
  modified_base (345)..(345): a, c, t, g, unknown or other
  modified_base (380)..(380): a, c, t, g, unknown or other
  modified_base (394)..(394): a, c, t, g, unknown or other
  modified_base (491)..(491): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgcaggctccgaggggagggctggagtgggtggccaanataaagccagatggaggtagtaaaacagtatgtagactcgtggtggagggccggttcaccatctccagagacaacgccaaagaatgacgatatatctacagatagaacngcctgccgagccgaggacacggctgtgtattacgnggtgggactcccgnggcgtggactacgtgtacgtccgaccgttggacgtcgaggactcgtcgtcaccgtctcctcacgcctccacgaacggccacgtccgtccttccccgnggcccgcccgtcgcccgtaccgacggacgcccgtaccgtccgagaaccgccgaaccgcggcccggtccccgtcggggtcctccggg

SEQ ID NO: 402888 - DNA, 660 bp, Homo sapiens
  misc_feature: GZ8MTXP02H2QK0.11.13.B02.1.454.CMB.2.raw
  modified_base (338)..(338): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgaggggaaggggctggagtgggtggccaacataaagccagatggaggtagtaaaacagtatgtagactctgtggagggccgttcaccatctccagagacaacgccaagaatgacgatatatctacagatgaacagcctgcgagccggaggcacggctggtagtatttcgtggtgggacttccgnggctggcacctgtactcccgtacgtggacgtcgagggtacctcgtcggtccacccgttctccctcacgtccctaccgaacccgaacgggccctacgtcccggttccctttccccccgtggcccgtccccgtcgcctacccgagggaccgaccgtaccccgtacccggacgacgaccgaaccgaccggcccggccccgttcggggcccgtcgtcccggttacgggtaccgtaaacggggtacctttaaacccggttcccgttacttcccgttccgtccgtccgttcggaacggcgggggtaccgtacggaccgaacgggcccg

SEQ ID NO: 402889 - DNA, 566 bp, Homo sapiens
  misc_feature: GZ8MTXP02JWLU0.11.13.B02.1.454.CMB.2.raw
  modified_base (260)..(260): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacngtatgtagactctgtggagggccgttcaccatctccagagacaacgccaaagaatgcgatatatctacagatgaaacagcctgccgagccgaggacacggctgtgtattacgtggtgggagtcccgtggctggccacctgtactcccggaccgttggagtcgaggggaactcgtcggtcaccgtctcctcacgccctacccaccgaacgggcccacgtccggtccttcccccgtcggcccgtccctcgcctccgacggcgccacccgtccgacgaacgcaacgacggccggcccgtcgggcctcgg

SEQ ID NO: 402890 - DNA, 564 bp, Homo sapiens
  misc_feature: GZ8MTXP02GGOC2.11.13.B02.1.454.CMB.2.raw
  modified_base (261)..(261): a, c, t, g, unknown or other
  modified_base (329)..(329): a, c, t, g, unknown or other
  modified_base (529)..(529): a, c, t, g, unknown or other
  modified_base (558)..(558): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccgttcaccatctccagagacaacgccaaagaatgcgatatatctanagatgaacagcctgccgagccgagacacggctgtgtattacgtggtgggacgtcccgtgggcttggcctaacccgtgtaacgtcccggtacccggtttgggacgtacgaaggggtaactcgtgggtaccaccgtctcctcacgcctccaccgaacggcccagtccggtccctccccgtgccgcctcgcctccgaggaccnccaccgcgagaacgcacgcgccggtccgnggctcg

SEQ ID NO: 402891 - DNA, 561 bp, Homo sapiens
  misc_feature: GZ8MTXP02JCGBV.11.13.B02.1.454.CMB.2.raw
  modified_base (262)..(262): a, c, t, g, unknown or other
  modified_base (339)..(339): a, c, t, g, unknown or other
  modified_base (357)..(357): a, c, t, g, unknown or other
  modified_base (492)..(492): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaagggctgggagtgggtggccaacataaagccagatgggagtgtaaaacngtatgtagactctggtggagggccggttcaccatcctcagagacaacgccaaagatgcatatatctacagatgaacngcctgccgagccgagacncggctgtgtattactggtgggacgtccctgggcctagggccaccgtgtactccggaccgttgacgtcgagggactcgtgtccaccgtctacctcacgccctaccacgaacggcccctagtccggtccttccccgnggccctccctgctacccgaggtacgcctacccgccgagaacgccaacgtcggccgcccgtgggcctcgg

SEQ ID NO: 402892 - DNA, 553 bp, Homo sapiens
  misc_feature: GZ8MTXP02IA3VE.11.13.B02.1.454.CMB.2.raw
  modified_base (239)..(239): a, c, t, g, unknown or other
  modified_base (265)..(265): a, c, t, g, unknown or other
  modified_base (269)..(269): a, c, t, g, unknown or other
  modified_base (334)..(334): a, c, t, g, unknown or other
  modified_base (379)..(379): a, c, t, g, unknown or other
  modified_base (492)..(492): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaaanataaagccagatggaggtgtaaaacngtangtagactctgtggagggccgttcaccatctccagagacaacgcaaagaatgcgatatatctaacngatgaaacagcctgcccgagccgaggacacggctgtgtatttacnggtgggacgtccctggctgcacctgtactccgaccgttggagtcagggaactcgtggtcaccgtctccgtcacgcctacccaccgaacgggcccagtccggtccttcccccgnggcccgtccctcgcctccgaggacgcaccgtcgagaacgcacacggccggcctgggctcgg

SEQ ID NO: 402893 - DNA, 573 bp, Homo sapiens
  misc_feature: GZ8MTXP02IZFKO.11.13.B02.1.454.CMB.2.raw
  modified_base (268)..(268): a, c, t, g, unknown or other
  modified_base (396)..(396): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgagggaaggggctgggagtgggtggccaacataaagccagatggaggtagtaaaacngtatgtagactctgtggagggccggttcaccatctccagagacaacgccaaagaatgcatatatctaacagatgaaacagcctgccgagccgaggacacggctgtgtattacgtggtgggactcccgngggctggcacctgtactccgtaccgttggacgtcgaggggactcgtcggtccaccgtctcctcacgccctaccacccgaacgggccccacgtccggtcccttcccccgtggcccgccctcgcctccgacggacgccacctccggacgaacgcacgacggccggcccgtcgggctcgg

SEQ ID NO: 402894 - DNA, 526 bp, Homo sapiens
  misc_feature: GZ8MTXP02I3ETN.11.13.B02.1.454.CMB.2.raw
  modified_base (348)..(348): a, c, t, g, unknown or other
  modified_base (415)..(415): a, c, t, g, unknown or other
  modified_base (419)..(419): a, c, t, g, unknown or other
  modified_base (422)..(423): a, c, t, g, unknown or other
  modified_base (425)..(425): a, c, t, g, unknown or other
  modified_base (431)..(431): a, c, t, g, unknown or other
  modified_base (436)..(436): a, c, t, g, unknown or other
  modified_base (443)..(443): a, c, t, g, unknown or other
  modified_base (499)..(499): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgcgagccgaggacacggctgtgtattactggtgggacgtccctggctggcacctgtanccgacgttgagtcagggactctggtcaccgtctcctcagcctcaccaaggcccatcgtcttccccgngccnccnncncgagcncaccncgagacncacgcgccgccgtggctcgccgtcgtacgaacggtacctacgttacctactcctcncgcgtgacggcggcgtcggacgacgcg

SEQ ID NO: 402895 - DNA, 534 bp, Homo sapiens
  misc_feature: GZ8MTXP02HZ10S.11.13.B02.1.454.CMB.2.raw
  modified_base (261)..(261): a, c, t, g, unknown or other
  modified_base (288)..(288): a, c, t, g, unknown or other
  modified_base (373)..(373): a, c, t, g, unknown or other
  modified_base (385)..(385): a, c, t, g, unknown or other
  modified_base (509)..(509): a, c, t, g, unknown or other
tcagcgagagataccacgaccggtgctcgatttagtctagcgactttgggttctccttgttgctattttagaaggtgtccagtgtgaggcgcagatggtggggtctggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccgttnaccatctccagagacaacgccaaagaatgcgatatatctacagatgaaacagcctgcccgagccgaggcacggctgtgtattacngtgggagtcccngggctgcacctgtatccgaccgttggagtcagggaactctggtcaccgtctcctcagcctccaccaggcccatcgtcttccccgtggccgtccctgcctccgacggacgccaccctccggacgngcacgacgccggccctcgggctcgg

SEQ ID NO: 402896 - DNA, 602 bp, Homo sapiens
  misc_feature: GZ8MTXP02GFJPE.11.13.B02.1.454.CMB.2.raw
  modified_base (301)..(301): a, c, t, g, unknown or other
  modified_base (548)..(548): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacagtatgtagactctggtggagggccggttcaccatcnccagagacaacgccaaagaatgcgatatatctacagatgaacagcctgccgagccgaggacacggctgtgtattacgtggtggggacgtcccgtgggcctgggcctaccgtgtacgtcccgaccgttggacgtcgagggtacctcgtggtcctacccgtctcctcacgccctacccgaacccgaacgggcccctacgtccggttccccttcccccgtggcccgtccccgtgccctaccgacgggtcncccgtaacccgtccggaacgcgaccaccggacgccggacccgtcggggcctcgg

SEQ ID NO: 402897 - DNA, 555 bp, Homo sapiens
  misc_feature: GZ8MTXP02IYBGW.11.13.B02.1.454.CMB.2.raw
  modified_base (263)..(263): a, c, t, g, unknown or other
  modified_base (290)..(290): a, c, t, g, unknown or other
  modified_base (326)..(326): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctgggagtgggtggccaacataaagccagatggaggtgtaaaacngtatgtagactctgtggagggccgttnaccatctccagagacacgccaaagaatgcgatatanctacagatgaaacagcctgccgagccgaggaccacggctgtgtattactggtggggatccctggctggcactgtactcccgaccgttggcgtcgagggaactcgtggtcaccgtctcctcacgccctccaccgaacgggcccagtccggtccttcccccgtgcccgccctgcctccgaggacgccgaccctccgacgaacgccaacgcggcccggccctcggggctcgg

SEQ ID NO: 402898 - DNA, 581 bp, Homo sapiens
  misc_feature: GZ8MTXP02GSS2R.11.13.B02.1.454.CMB.2.raw
  modified_base (498)..(498): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctgggagtgggtggccaacataaagccagatggaggtgtaaaacagtatgtagactctgtggagggccggttcaccatctccagagacaacgccaagaatgcgatatatctacagatgaacagcctgccgagccgaggacacggctgtgtattactggtgggagtcccgtggctggcacctgtactccgaccgttggagtcgagggtaactcgtggtcaccgttctcctcacgccctacccacccgtaacgggcccctagttcccggtccttccccccgnggtccccgcccgttcgcctcccgacgggacgcccgacccgtccgacgaacggccacgacggcccggcccgtcggggcctccgg

SEQ ID NO: 402899 - DNA, 611 bp, Homo sapiens
  misc_feature: GZ8MTXP02H59MI.11.13.B02.1.454.CMB.2.raw
  modified_base (270)..(270): a, c, t, g, unknown or other
  modified_base (274)..(274): a, c, t, g, unknown or other
  modified_base (360)..(360): a, c, t, g, unknown or other
tcagcgagagataccacgaccggtgctcgatttagtctagcgactttgggttctccttgttgctattttagaaggtgtccagtgtgaggcgcagatggtggggtctggggggaggcttgggtccagcctgggggggtccctgagactctcctgtacagcctctggattcagcatcagttcgtattggatgaattgggtccgccaggctccgaggggaaggggctgggaggtgggtggaccaacataaagccagatggaggtagtaaaacngtangtagactcgtggtggacgggtccgttcaccatcctaccagacgaccaacgaccaaagaatgacaatatatctaacagatagaaacncgcctgccgagccgaggacacgctgtgtattacgtgggtggacgtccgtggctcggcacgtgtactcccggacggttggacgtacgaggggtaactcgtcggtaccaccgttccgtcctcacgccctaccgaaccgaacgggccctacgtcccgtccccttccccgcggtcccgtcctcgcccgtaccgacggacacccgtacccgtaccgacgaaccgccaacgaccggccggcccgtcggggcctccgg

SEQ ID NO: 402900 - DNA, 575 bp, Homo sapiens
  misc_feature: GZ8MTXP02H5KNH.11.13.B02.1.454.CMB.2.raw
  modified_base (264)..(264): a, c, t, g, unknown or other
  modified_base (531)..(531): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtgtaaaacngtatgtagactctgtggagggccgttcaccatctccagagacaacgccaaagaatgacgatatatctacagatagaacagcctgccgagccgagacacggctgtcgtattactggtgggatcccgtgctcggcacccgtgtactcccggaccgtttggacgttcgaaggggaacctcgtcggtcacccgtctccgtcacgccctccaacccgaacgggccctagtccggttccctcccccgtggcccgccctgccctccgacggacnccgaccctccgagaacgccaacgcggccgcccgtggggcctcgg

SEQ ID NO: 402901 - DNA, 546 bp, Homo sapiens
  misc_feature: GZ8MTXP02GNBAY.11.13.B02.1.454.CMB.2.raw
  modified_base (261)..(261): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaaagaatgcgatatatctacagatgaaacagcctgccgagccgaggacacggctgtgtattactgtgggatccctggctggcacctgtatccgaccgttggagtcgagggaactcgtggtccaccgtctcctcagccctacccaccaacgggcccatccggtccttcccccgtggccgccctggcctccaggacgccacctcccgagaacgcacacgccggcccgtcggggctcgg

SEQ ID NO: 402902 - DNA, 572 bp, Homo sapiens
  misc_feature: GZ8MTXP02GXD35.11.13.B02.1.454.CMB.2.raw
  modified_base (296)..(296): a, c, t, g, unknown or other
  modified_base (527)..(527): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctggagtgggtggccaaacataaagcagatggaggtagtaaaacagtatgtagactctgtggaggcgttcaccatcncagagacaacgcaaagaatgacgatatatctacagatgaaacagcctgccgagccgagacacggctgtgtattactgtgggacgtcccgtgctggcaccgtgtactcccgtaccgttggacgtacgaacgggtaactcgtcggtccacccgtctccctcaacgccctaccaacccgaacgggcccagtccggtcccttcccccgtcgcccgtccctcgctcccgaggaccnccgaccgtcgaacgaacgcaacgacggccggcccggtcggcgtcg

SEQ ID NO: 402903 - DNA, 614 bp, Homo sapiens
  misc_feature: GZ8MTXP02GL13R.11.13.B02.1.454.CMB.2.raw
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgagggaaggggctgggagtgggtggccaacataaagccagatggaggtagtaaaacagtatgtagactctgtggagggccggttcaccatctccagagacaacgccaaagaatgcgatatatctacagatagaaacagcctggccgagccgaggacacggctgtgtattacgtggtgggactcccgtgggctggcctacctgtactccggtacgttggagtcgaggggaactcgtcggtccacccgttctccctcaccgtccctacccgaacccgaacgggcccctacgttcccggttcccttcccccgtcgggccccgtccccgtcgccctacccgacgggacgacccgacccgtccgacgaaccgaccgacgaccgggcccggtccccggtcggggccgtccgg

SEQ ID NO: 402904 - DNA, 593 bp, Homo sapiens
  misc_feature: GZ8MTXP02FP92S.11.13.B02.1.454.CMB.2.raw
  modified_base (236)..(236): a, c, t, g, unknown or other
  modified_base (543)..(543): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtggccaanataaagccagatggaggtagtaaaacagtatgtagactctggtggagggccggttcaccatctccagagacaacgccaaagaatgacgatatatctaacagatagaacagcctgccgagccgaggacacggctgtgtattacgtggtgggacttcccgtgggctggcaccctgtaactccggtaccgttggacgtcgaagggtactcgtcggtccaccgtctcccgtcaccgcccctaccgaacccgaacgggcccctagttcccggttcccttcccccgtggcccgccctgccctaccggaggacncccgaacctccggagaacgccaacgacggcccggtcccgtcgggctccgg

SEQ ID NO: 402905 - DNA, 563 bp, Homo sapiens
  misc_feature: GZ8MTXP02IJF3K.11.13.B02.1.454.CMB.2.raw
  modified_base (266)..(266): a, c, t, g, unknown or other
  modified_base (278)..(278): a, c, t, g, unknown or other
  modified_base (281)..(281): a, c, t, g, unknown or other
  modified_base (344)..(344): a, c, t, g, unknown or other
  modified_base (531)..(531): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaattgggtcccgccaggctccgaggggaaggggctgggagtgggtggccaacataaagccagatggaggtgtaaaacngtatgtagactntgnggagggccgttcaccatctccagagacaacgccaaagaatgcgatatatctacagatgaaacngcctgccgagccgagacacggctgtgtattacgtggtgggactcccgtgggctggcaccgtgtacgtcccgaccgttggacgtcgaggggtactcgtcggtcacccgtctccctcacgccctaccaccgaacgggcccctagtcccggtcccttcccccgtggcccgtccctcgcctccgaggaccnccaccgcgagcgcacgcgccgccgtcggctcg

SEQ ID NO: 402906 - DNA, 594 bp, Homo sapiens
  misc_feature: GZ8MTXP02FY7GO.11.13.B02.1.454.CMB.2.raw
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgagggaaggggctgggagtgggtggccaacataaagccagatggaggtagtaaaacagtatgtagactctggtggagggccggttcaccatctccagagacaacgccaaagaatgcgatatatctacagatgaaacagcctgccgagccgagacacggctgtgtattacgtggtgggacgtccctgggctggcctaccgtgtactccgtaccgttggacgtacgagggtaacctcgtcggtccaccgtcctccctcacgtccctaccaacccgaacgggccctacgtccggttcccgttcccccgtggccccgtcccgtcgccctccgacggacgacccgaccgtccgacgaacgccacgacggcccggcccgtcggggctccgg

SEQ ID NO: 402907 - DNA, 542 bp, Homo sapiens
  misc_feature: GZ8MTXP02GHW6K.11.13.B02.1.454.CMB.2.raw
  modified_base (264)..(264): a, c, t, g, unknown or other
  modified_base (292)..(292): a, c, t, g, unknown or other
  modified_base (401)..(401): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctgggagtgggtggccaacataaagccagatggaggtagtaaaacngtatgtagactctgtggagggccggttnaccatctccagagacaacgccaaagaatgcatatatctacagatgaacagcctgccgagccgaggacacggctgtgtattacgtgtgggatccctggctgcacctgtanccgaccgttggagtcagggaactcgtggtcaccgtctcctcacgccctccaccagggcccactcggtcctcccccgtgccgccctcgcctccgaggacgcacccgtccgagaacgcaacgacgccggccctcggggctcgg

SEQ ID NO: 402908 - DNA, 556 bp, Homo sapiens
  misc_feature: GZ8MTXP02HLVB0.11.13.B02.1.454.CMB.2.raw
  modified_base (265)..(265): a, c, t, g, unknown or other
  modified_base (392)..(392): a, c, t, g, unknown or other
  modified_base (494)..(494): a, c, t, g, unknown or other
  modified_base (500)..(500): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacngtatgtagactctggtggagggccggttcaccatctccagagacaacgccaaagatgcgatatatctacagatgaacagcctgccgagccgaggacacggctgtgtattacgtggtgggacgtcccnggctggcacctgtactccgaccgttggagtcgagggaactcgtggtccaccgtctcctcacgccctaccaccgaacgggcccagtccggtcccttcccccgnggcccnccctgcctccgaggacgccaccgtccgagaacgcacgacgccgcccgtgggctcgg

SEQ ID NO: 402909 - DNA, 587 bp, Homo sapiens
  misc_feature: GZ8MTXP02HNPSJ.11.13.B02.1.454.CMB.2.raw
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgagggaaggggctggagtgggtggccaaacataaagccaagatggaggtagtaaaacagtatgtagactctggtggagggccgttcaccatctccagagacaacgccaaagaatgcgatatatcaacagatagaacagcctgccgagccgagacacggctgtgttattacgtggtcgggtacgtcccgtgggcgtggcctaccgttgtaactcccggtaccgttgggacgtcgaagggtactcgtcggtccgtacccgttcctcccttcgacgtccctacccgaaccgaacgggcccacgttccggttcccttccccgcggcccgccctcgcctccgacgcgccaccgtccgacgcgcacgcgccggccgtcggctcg

SEQ ID NO: 402910 - DNA, 580 bp, Homo sapiens
  misc_feature: GZ8MTXP02J3D6H.11.13.B02.1.454.CMB.2.raw
  modified_base (199)..(199): a, c, t, g, unknown or other
  modified_base (259)..(259): a, c, t, g, unknown or other
  modified_base (353)..(353): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagacctctcctgtacagcctctggattcagcatcagttcgtattggatgaattgggtccnccaggctccagggaagggctggagtgggtgccaacataaagccagatggagtgtaaaacngtatgtagactctgtggagggccgttcaccatctcagagacaacgccaaagatgcgatatatctacagatgaacagcctgcccgagccgagacncggctgtgtattactggtggactccctggcctgcaccctgtactcccggaccgttgggacgttcgacggggaaccttcgtcggtccaccgtcctctcacgccctccacccgaacgggccccatcccgggtccttccccccgtggcccgtccctcgaccttcccgacgggacaccgaccctccgaacgaacgcaacacgggcccggtccccgttggggaccttccggg

SEQ ID NO: 402911 - DNA, 614 bp, Homo sapiens
  misc_feature: GZ8MTXP02HIDPI.11.13.B02.1.454.CMB.2.raw
  modified_base (201)..(201): a, c, t, g, unknown or other
  modified_base (406)..(406): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagccgtgggggggtccctgagactctcctgtacagcctctggattcagcatcagttcgtattggatgaattgggtccnccaggctccgaggggaaggggctgggagtgggtggccaacataaagccagatggaggtagtaaaacagtatgtagactcgtggtgggacgggccgttcaccatcctaccagacgaccaacgccaaagatgcaatatatctaacagatagaaacagcctgaccgacgccgaggacacggcttgtgtattacgtggtgggactccgngggtctggccacccgtgtacgtccggtaccgttggacgtacgaagggtaactcgtcggtaccacccgttcctccctcgaccgccctacccgaaccgacgggcccctacgtcccgtcccttcccccgtcggccccgtcccgtcgccctaccgacggaccgaccacccgtccgagaacgccaacgcggccggccccgtcgggcctaccgg

SEQ ID NO: 402912 - DNA, 603 bp, Homo sapiens
  misc_feature: GZ8MTXP02F99YG.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgaggggaaggggctggagtgggtggccaaacataaagccagatggaggtagtaaaacagtatgtagactctgtggagggccggttcaccatctccagagacaacgccaagaatgcgatatatctacagatgaacagcctgcgagccgaggacacggctgtgtattactggtgggatccctggctggcacctgtactccgacgttggagtcgagggactcgtggtccaccgtctcctcacgccctccaacccgaacgggcccacgtcccggtcccttcccccgtggcccgccctcgcctcccgacggacgccacccgtccgacgacgccacgacggccggcccgtggggcctcggcccgtcgggtaccgaaacgggtaccttaccgtttacccggtacttccgtccgttccgcgttacggacggccggggcgttcgggaccgaagggccg

SEQ ID NO: 402913 - DNA, 578 bp, Homo sapiens
  misc_feature: GZ8MTXP02GCZ60.11.13.B02.1.454.CMB.2.raw
  modified_base (233)..(233): a, c, t, g, unknown or other
  modified_base (389)..(389): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggagggctggagtgggtgccaanataaagccagatggaggtgtaaaactgtatgtagactctgtggagggccggttcaccatctccagagacaacgccaaagaatgacgatatatctacagatgaaacagcctgccgagccgaggaccaggcttgtgtattacgtggtgggacgtcccngggctggcaccgtgtactccgtaccgttggagtcgaggactcgtggtccaccgtctccgtcacgccctaccaccgtaacgggcccacgtccggtcccttcccccgtggcccgtcccgttacgccgtccgacggacgcccgtaacccgtccgaagaacggaccacgacggccggcccgtcggggcctcgg

SEQ ID NO: 402914 - DNA, 653 bp, Homo sapiens
  misc_feature: GZ8MTXP02IZ3BB.11.13.B02.1.454.CMB.2.raw
  modified_base (354)..(354): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctggagtgggtggccaacataaagccagatgggaggtagtaaaacagtatgtagactcgtggtgggagggccggttcaccatcctccagagaaccaacgccaaagaatgacgatatatctacagatagaaacngcctgccgacgccgaggacacggctggtgtattacgtggtgggactcccgtgggcctgggcctaccgtgtactccggtacgttggacgtcgagggtactcgtggtacccaccgttcctccctacaccgtccctacccgaccgaacggccctacgttccccggttccctccccggcggcccgtccccgtcggtcccgtacccggaaacgggcctaccccgtacccgtaccggaacgaaccggaccccgaaaccggtcccggggccccgggtccccggttacgggggtccctttcccgggg

SEQ ID NO: 402915 - DNA, 547 bp, Homo sapiens
  misc_feature: GZ8MTXP02IX5IA.11.13.B02.1.454.CMB.2.raw
  modified_base (261)..(261): a, c, t, g, unknown or other
  modified_base (288)..(288): a, c, t, g, unknown or other
  modified_base (323)..(323): a, c, t, g, unknown or other
  modified_base (366)..(366): a, c, t, g, unknown or other
  modified_base (376)..(376): a, c, t, g, unknown or other
  modified_base (447)..(447): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaagggctggagtgggtggccaacataaagccagatggagtgtaaaacngtatgtagactctgtggagggccgttnaccatctccagagacaacgccaaagaatgcgatanatctaacagatgaaacagcctgccgagccgaggacacggctgngttattacgngtgggatccctgggctggcacctgtactccgaccgttggagtcgagggaactcgtggtcaccgttctcctnacgcctaccaccgaagggcccagtccggtcttcccccgtgccgccctggacctaccgacggacgccacctcgagcgcaacgcgccgtcccggcggtctcg

SEQ ID NO: 402916 - DNA, 612 bp, Homo sapiens
  misc_feature: GZ8MTXP02IBGIP.11.13.B02.1.454.CMB.2.raw
  modified_base (338)..(338): a, c, t, g, unknown or other
tcagcgagagataccacgaccggtgctcgatttagtctagcgactttgggtttgtgggaggcttggtccagcctggggggtccctgagactctcctgtacagcctctggattcagcatcagttcgtattggatgaattgggtccgccaggctccgaggggaagggctggagtgggtgccaacataaagccagatggaggtagtaaaacagtatgtagactctggtggagggccgttcaccatctccagagacaacgccaagaatgcgatatatctacagatagaacagcctgcgagccgaggacacggctgtagtattacgtggtgggacgttcccgnggcctggcctaccgtgtaaccgtcccggtacggttggagttccgaagggtaccttcgtcggtccacccgtcctcctcacgccctaccaccgaacggcccacgtcccgtcccttcccccgtcggcccgcccgtcgcctccgacggacgaccctacccgtccgagacgaccacgacggccggcccgtgggcctcggccgtacggtaccgaaacggtaccttaccgttccgttactccgttcgtcgcgtcggacggcgggtacgcggacgaacggcg

SEQ ID NO: 402917 - DNA, 553 bp, Homo sapiens
  misc_feature: GZ8MTXP02IIT44.11.13.B02.1.454.CMB.2.raw
  modified_base (257)..(257): a, c, t, g, unknown or other
  modified_base (264)..(264): a, c, t, g, unknown or other
  modified_base (291)..(291): a, c, t, g, unknown or other
  modified_base (343)..(343): a, c, t, g, unknown or other
  modified_base (370)..(370): a, c, t, g, unknown or other
  modified_base (492)..(492): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgagggaaggggctggagtgggtgccaacataaaagccagatggaggtntaaaacngtatgtagactctgtggagggccgttnaccatctccagagacaacgccaaagaatgcgatatatctaacagatgaaacngcctgccgagccgaggacacggctgtntattactggtggacgtccctgggctggcaccgtgtatccgaccgttggagtcagggaactctggtcacccgtctcctcacgcctaccaaccgaaacgggcccagtccggtcctttcccccgnggcccgtccctgcctccgaggacgccacctccgagaacgcacgacgcggccctgggctcgg

SEQ ID NO: 402918 - DNA, 607 bp, Homo sapiens
  misc_feature: GZ8MTXP02IKTO5.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtagtaaaacagtatgtagactctggtggagggccggttcaccatctccagagacaacgcaagaatgcgatatatctacagatgaacagcctgcgagccgaggacacggctgtgtattacgtggtgggacgtccctggctggcaccgtgtacgtcccgtaccgttggacgtacgacgggtactcgtaggtccacccgttcctcctcacgccctccaccgaacggcccagttcccgtccttccccccgtggcccgcccgtcgtcctaccgacggacgcccgacccgtccggacgacgccgacgacggccggtccccgtggggcctcggcccgttcgggtacgtaaacgggtaccttaccgttccgtactccgttctacgtcgtcggacggcgggcgtcggacgaacggcg

SEQ ID NO: 402919 - DNA, 581 bp, Homo sapiens
  misc_feature: GZ8MTXP02GKV4A.11.13.B02.1.454.CMB.2.raw
  modified_base (239)..(239): a, c, t, g, unknown or other
  modified_base (266)..(266): a, c, t, g, unknown or other
  modified_base (347)..(347): a, c, t, g, unknown or other
  modified_base (397)..(397): a, c, t, g, unknown or other
  modified_base (473)..(473): a, c, t, g, unknown or other
  modified_base (543)..(543): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctggagtgggtggccaanataaagccagatggaggtagtaaaacngtatgtagactctggtggagggccggttcaccatctccagagacaacgccaaagaatgacgatatatctacagatgaaacngcctgaccgagccgaggacacggctgtgtattactgggtgggactcccgngggctcggctaccgtgtactcccggtacgttaggacgtcgaacgggtaactcgtcggtaccaccgtctccctcacnccctaccaacccgaacgggcccctagtcccggtccttcccccgtggccctcccgtcgcctccgacggacnccacctccgacgaacgcacgcgccggccgtcggctcgg

SEQ ID NO: 402920 - DNA, 631 bp, Homo sapiens
  misc_feature: GZ8MTXP02HJF67.11.13.B02.1.454.CMB.2.raw
  modified_base (287)..(287): a, c, t, g, unknown or other
  modified_base (505)..(505): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacagtatgtagactctgtggagggccggttcaccatctccagagacaacgccaagaatgcgatatatctacagatgaacngcctgcgagccgaggacacggctgtgtattacgtggtggggacgtccccgtgggccgtgggcctaccgtcggtaacgtcccggtaccggtttgggacgttccggaaggggtaccttcgttgggtccctaccgttcctccctacacgccctacccgacccgtaacgggcccacgttcccgtcccttcccccgtcggcccgtccctcgcctccgaggccnccaccgtccgagacgccaacgcggccggtccgtgggcctcggcccgttcggaccaacgggtaccttaccgtttccgtacgtccttccgtccgcgtcggacggtccgggtcgtcgggacgacggccg

SEQ ID NO: 402921 - DNA, 588 bp, Homo sapiens
  misc_feature: GZ8MTXP02HNU8X.11.13.B02.1.454.CMB.2.raw
  modified_base (264)..(264): a, c, t, g, unknown or other
  modified_base (395)..(395): a, c, t, g, unknown or other
  modified_base (473)..(473): a, c, t, g, unknown or other
  modified_base (518)..(518): a, c, t, g, unknown or other
  modified_base (543)..(543): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctggagtgggtggccaacataaagccagatggaggtagtaaaacngtatgtagactctggtggagggtccgttcaccatctccagagacaacgccaaagaatgcatatatctacagatgaaacagcctgccgagccgaggacacggctgttgtattacgtgtcggggacgtcccgnggctggcacccgtgtaccgtccgtacccggtttggacgtcgaagggtacctcgtcggtccaccgttcctccgtcgacncccgtacccaaccgtaacgggccccagtcccggtccttcccccgngcccgtccctgaccctccgaggacnccgacctccgagaacgcgaaccgtcggccgtcccggcggtcgtcg

SEQ ID NO: 402922 - DNA, 536 bp, Homo sapiens
  misc_feature: GZ8MTXP02IYGRY.11.13.B02.1.454.CMB.2.raw
  modified_base (230)..(230): a, c, t, g, unknown or other
  modified_base (255)..(255): a, c, t, g, unknown or other
  modified_base (288)..(288): a, c, t, g, unknown or other
  modified_base (467)..(467): a, c, t, g, unknown or other
  modified_base (515)..(515): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattggtccgccaggctccagggagggctggagtggtgccaanataaagcagatggaggtgtaaaacngtatgtagactctgtggaggccgttcaccatcnccagagacaacgccaagaatgcgatatatctaacagatgaacagcctgcccgagccgaggacacggctgtgtatactggtgggatcccgtggctggcactgtactcgacgttgagtcaggtaactcgtgtcaccgtctcctcacgcctaccaccgacggcccatcggtccttcccccgnggccctcctcgcctaccgcggacgccgtaccgtccggagaacgcaacncggccgccccgtgggcctcgg

SEQ ID NO: 402923 - DNA, 617 bp, Homo sapiens
  misc_feature: GZ8MTXP02IK5AH.11.13.B02.1.454.CMB.2.raw
  modified_base (383)..(383): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatggaggtagtaaaacagtatgtagactctggtggagggccggttcaccatctccagagacaacgccaaagaatgcgatatatctacagatgaaacagcctgccgagccgaggacacggcttgtgtattacgnggtgggactcccgtggctggcaccgtgtacgtcccggtaccgttggacgtacgagggtaacctcgtacggtccacccgttctccctcacgccctaccaccgaacgggccctagtcccggttcccttcccccgtcggccccgtcccgtcgcccgtaccgacgggaccgacccgaccccgtaccgacgaaccgccgaaccggtccggcccgggccccggtcggggtaccctccggg

SEQ ID NO: 402924 - DNA, 630 bp, Homo sapiens
  misc_feature: GZ8MTXP02I8VNV.11.13.B02.1.454.CMB.2.raw
  modified_base (269)..(269): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaaacataaagccagagtggaggtagtaaaacngtatgtagactctggtggagggccggttcaccatctccagagacaacgcaaagatgcatatatctacagatagaacagcctgccgagccggagacacggctgtgtattacgtggtgggacgtccgtggctcgcctacgtgtacgtccggtacgttggacgtcgagggtacttcgtcgggtacctacccggttcctcctccgaccgtccctaccccgaaccgaaccggggcccctacgttccccgggttccccttcccccggtggccccgtccccgtagtcccgtcccgacgggacctcccgaaccccgtccggaaggaaccgaccaccggtaccggccccggcccgttggggcccttccgg

SEQ ID NO: 402925 - DNA, 549 bp, Homo sapiens
  misc_feature: GZ8MTXP02F09ME.11.13.B02.1.454.CMB.2.raw
  modified_base (259)..(259): a, c, t, g, unknown or other
  modified_base (503)..(503): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtgccaacataaagccagatggaggtgtaaaacngtatgtagactctgtggagggccggttcaccatctccagagacaacgccaaagaatgcgatatatctacagatgaacagcctgccgagccgagacacggctgtgtatactgtgggatcccgtggctggcacctgtactccgacgttggagtcgagggaactcgtgtcaccgtctcctcacgcctaccaccaacgggcccagtccggtccttcccccgtggcccgccctcggcctaccgaggacnccgacccgtcccgagaacgcaacgacggccggcccgtggggctcgg

SEQ ID NO: 402926 - DNA, 576 bp, Homo sapiens
  misc_feature: GZ8MTXP02JEYU8.11.13.B02.1.454.CMB.2.raw
  modified_base (467)..(467): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactctggtggagggccggttcaccatcctaccagagaccaacgccaaagaatgcatatatctacagatagaacagcctgccgagccgagacacggctgtgtattacgtggtggggactccctgggcgtggctaccgtgtacgtccggtaccgttggacgtcgagggtactcgtggtccaccgttctccctnaccgtcctacccaccgacgggcccagtcccggtcccttcccccgtgcccgtcccgtcgcctccgaggcgccacccgtccgagaacgcacgcggccggccctgggctcgg

SEQ ID NO: 402927 - DNA, 571 bp, Homo sapiens
  misc_feature: GZ8MTXP02IKUG1.11.13.B02.1.454.CMB.2.raw
  modified_base (231)..(231): a, c, t, g, unknown or other
  modified_base (385)..(385): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgaggggaaggggctggagtgggnggccaacataaagccagatggaggtagtaaacagtatgtagactcgtgtggagggccgttcaccatcctaccagaacgaccaacgccaaagaatgcgaatatatctacagatgaaacagcctgcccgagccgaggacacggctgtgtattacgnggtggacgtcccgtggctgacaccgtgtacgtcccggtaacgttggacgttacgacgggtaactcgtcggtccacccgtctccgtcacgccctaccaccgaacggccctacgtccgttcccttcccgcgcctcctcgctccgacggacgccaccgtcgacgcgtcacgtcgcggcctcgggctcgg

SEQ ID NO: 402928 - DNA, 655 bp, Homo sapiens
  misc_feature: GZ8MTXP02HZ1RM.11.13.B02.1.454.CMB.2.raw
  modified_base (264)..(264): a, c, t, g, unknown or other
  modified_base (587)..(587): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaagggctgggagtgggtggccaaacataaaagccagatggaggtgtaaaacngtatgtagactctgtggagggccggttcaccatctccagagacaacgccaaagaatgcgatatatctaacagaatgaaacacgcctcgaccgagccgaagggacacggcttgtgtactttacgtggtggggacgtccccgtgggtctgccacccgttgtaactcccggaacccggtttggaacgtcgaacggggaaccttcgtcgggttaccgacccgttcctcccgttcacgccccgtacccaacccgaaacggggcccctaacgtccgggttccccttcccccgtcggccccgtccccgtcggccctaccgaacggggacnccccgaacccgtcccggaacggaacgacccgaacgacgggccccggccccggttcggggaccctccgg

SEQ ID NO: 402929 - DNA, 594 bp, Homo sapiens
  misc_feature: GZ8MTXP02GVWXL.11.13.B02.1.454.CMB.2.raw
  modified_base (264)..(264): a, c, t, g, unknown or other
  modified_base (343)..(343): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccgaggggaagggctggagtgggtggccaacataaagccagatggaggtagtaaaacngtatgtagactctgtggagggccggttcaccatctccagagacaacgcaaagaatgacgatatatctacagatgaaacngcctgccgagccgagacacggctgtgtattacgtggtagggcgtcccgtggctggcaccgtgtactccgacgttggagtcgagggtactcgtgtaccaccgtctcctcgacgtccctacccaaccgaacgggccctatcccggttcccttcccccgtgcccgtacccgtcggcctcccgagggaccacccgtaccgtacccgaacgaacgcccgtaaaccgcggcccgggtcccgtcgggggccttccggg

SEQ ID NO: 402930 - DNA, 571 bp, Homo sapiens
  misc_feature: GZ8MTXP02JC8TC.11.13.B02.1.454.CMB.2.raw
  modified_base (515)..(515): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactctgtggagggccggttcaccatctccagagacaacgccaaagaatgcgatatatctacagatgaacagcctgccgagccgaggacacggctgtgtattacgtggtggggactcccgtgggcctggcctaccgtgtacgtcccggtaccggttgacgtacgacggggtaactcgtcggtccaccgttctccctcacgccctaccaaccgacggcccagtccgtccttccccgtgccnccctcgcctccgagacgccaccgtccgagaacgcacgcggccgccgtgggcctcgg

SEQ ID NO: 402931 - DNA, 540 bp, Homo sapiens
  misc_feature: GZ8MTXP02HTDRD.11.13.B02.1.454.CMB.2.raw
  modified_base (262)..(262): a, c, t, g, unknown or other
  modified_base (374)..(374): a, c, t, g, unknown or other
  modified_base (502)..(502): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccggttcaccatctccagagacaacgccaaagatgcgatatatctacagatgaaacagcctgccgagccgaggacacggctgtgtattacngtggggatcccgtggctgcacctgtactccggacgttggagtcgagggactcgtgtcctaccgtctcctcacgccctccaccgacgggcccagtccgtcctcccctgccgccctgcctccgacggacnccgacctccgagcgcacgcggccggcccgtgggctcgg

SEQ ID NO: 402932 - DNA, 604 bp, Homo sapiens
  misc_feature: GZ8MTXP02FLCCX.11.13.B02.1.454.CMB.2.raw
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgagggaaggggctggagtgggtggccaacataaagccagatggagtagtaaacagtatgtagactctggtggaggccggttcaccatctcagagacaacgccaagaatgcgatatatctacagatagaacagcctgccgagccgaggacacggctgtgtattactggtagggtacgtcccgtgggctggctaccgtgtactccggtaccgttggagtcgaagggtactcgtcggtacctaccgtctcctcaccgccctacccgaaccgaacgggcccctacgttcccggtcccttcccccgtcgggccccgtccctcggtccctacccgagggaccgtcccgaacccgtcggacggaacgaccgacgacgggcccggaccgtcggggcctacgg

SEQ ID NO: 402933 - DNA, 576 bp, Homo sapiens
  misc_feature: GZ8MTXP02FJ4C5.11.13.B02.1.454.CMB.2.raw
  modified_base (347)..(347): a, c, t, g, unknown or other
  modified_base (465)..(465): a, c, t, g, unknown or other
  modified_base (535)..(535): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatgggaggtagtaaaacagtatgtagactctggtggagggccggttcaccatctccagagacaacgaccaaagatgcgatatatctacagatgaacngcctgccgagccgaggacacggctgtgtattacgtggtggggactcccgtggctgggcctaccgtgtacgtcccggtaccgttggacgtcgaagggactcgtcgtccaccgtctcccncacgccctaccacccgaacggccctagtcccggtccctccccgtcgccctcccgtgccctccgacggacnccgacccgcgagcgcaccgacgccggccgtcggggctccgg

SEQ ID NO: 402934 - DNA, 571 bp, Homo sapiens
  misc_feature: GZ8MTXP02F2EWO.11.13.B02.1.454.CMB.2.raw
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgagggaaggggctgggagtgggtggccaacataaagccagatggaggtgtaaaacagtatgtagactctgtggagggccggttcaccatctccagagacaacgccaaagaatgcgatatatctacagatgaacagcctgccgagccgaggacacggctgtgtattacgtgtgggatcccgtggctgcacctgtactccgaccgttggagtcgagggactcgtgtccaccgtctcctcacgccctaccaccgacgggcccagtcccgggtcccttcccccgtggcccgtcccgtacgcctaccgacggacgcccacccgtccggaacgaacggccaacgcggccggtcccggtcgggactccggg

SEQ ID NO: 402935 - DNA, 571 bp, Homo sapiens
  misc_feature: GZ8MTXP02JZRJH.11.13.B02.1.454.CMB.2.raw
  modified_base (265)..(265): a, c, t, g, unknown or other
  modified_base (378)..(378): a, c, t, g, unknown or other
  modified_base (455)..(455): a, c, t, g, unknown or other
  modified_base (501)..(501): a, c, t, g, unknown or other
  modified_base (527)..(527): a, c, t, g, unknown or other
  modified_base (534)..(534): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtagtaaaacngtatgtagactctgtggagggccggttcaccatctcagagacaacgccaaagaatgcgatatatctacagatgaaacagcctgccgagccgaggacacggctgtgtattacgnggtgggatcccgtggctcggcacctgtactcccgaccgttggacgtcgagggaactcgtggtccaccgtctcctacncgccctaccgaccgaaccgggccctagtcccggtcccttcccccgnggcccgcccgtcgccaccgacggacnccgaccncccgagaacgccaacgcggccggccgtcgggcctcgg

SEQ ID NO: 402936 - DNA, 588 bp, Homo sapiens
  misc_feature: GZ8MTXP02ICR41.11.13.B02.1.454.CMB.2.raw
  modified_base (264)..(264): a, c, t, g, unknown or other
  modified_base (291)..(291): a, c, t, g, unknown or other
  modified_base (340)..(340): a, c, t, g, unknown or other
  modified_base (359)..(359): a, c, t, g, unknown or other
  modified_base (375)..(375): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctgggagtgggtggccaacataaagccagatggaggtagtaaaacngtatgtagactctgtggagggccgttnaccatctccagagacacgccaagaatgcgatatatctacagatgaaacngcctgccgagccgaggacncggctgtgtattacgnggtggggacgtcccgtgggctggcaccgtgtactccgaccgttggacgtcgacgggtaactcgtggtccaccgtctccctcacgccctacccgacccaacggggcccctagtcccggtccttcccccgtcggcccgtcccgtcgcctccgacgggacgccgaacccgtccggaacgaacgccgaccgacggcccggacccgtcgggccgtcgg

SEQ ID NO: 402937 - DNA, 638 bp, Homo sapiens
  misc_feature: GZ8MTXP02GJX4O.11.13.B02.1.454.CMB.2.raw
  modified_base (265)..(265): a, c, t, g, unknown or other
  modified_base (578)..(578): a, c, t, g, unknown or other
  modified_base (594)..(594): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttgggtccagcctgggggggtccctgagactctcctgtacagcctctggattcagcatcagttcgtattggatgaattgggtccgccaggctccgaggggaagggctgggagtgggtgaccaacataaagcagatggaggtagtaaangtatgtagactcgtggtggacgggtccgttcaccatcctaccagacgaacaacgccaaagaatgacgaatatatacaacagatagaaacacgcctggccgaggccgaaggaccacggtcttgtgttacttcggtgggtcgggtacgtccgtgggcgtcgcaccgtgtactccggtacggtttggacgtacgagggtactcgtcggtccacccgtctcctcaccgtccctacccgaacccgaccggtccctacgttccccggtccccttcccccggtcggccccgtcccgtcggccctacccggacgggtaccnccctacccgtccgganaaccggaccacggaccggcccggtacccgtcggggccctccggg

SEQ ID NO: 402938 - DNA, 576 bp, Homo sapiens
  misc_feature: GZ8MTXP02HRCQW.11.13.B02.1.454.CMB.2.raw
  modified_base (269)..(269): a, c, t, g, unknown or other
  modified_base (314)..(314): a, c, t, g, unknown or other
  modified_base (345)..(345): a, c, t, g, unknown or other
  modified_base (384)..(384): a, c, t, g, unknown or other
  modified_base (520)..(520): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggaggtgggtggccaaacataaagccagatggaggtagtaaaacngtatgtagactcgtggtggacgggccggttacaccatctccaganacaacgccaaagaatgacgaatatatctaanagatagaaacagcctgccgagccgaggacacggcttgtntattacgtgtcgggatcccgtgccgtggcctaccgtgtactcccgacgttggacgtcgagggaacttcgtcggtcctaccgtctcctcacgccctaccacgaacggccctacgtcggtcctccccgtgcccgtccngctaccgaggaccacgtaccctcgagaacgcgacgacgccgtcccggtggactcgg

SEQ ID NO: 402939 - DNA, 693 bp, Homo sapiens
  misc_feature: GZ8MTXP02JSMNB.11.13.B02.1.454.CMB.2.raw
  modified_base (269)..(269): a, c, t, g, unknown or other
  modified_base (391)..(391): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatgggaggtagtaaaacngtatgtagactctggtggagggccggttcaccatcctccagagaacaacgccaaagaatgacgaatatatctaacagatagaacagcctggccgacgccgaggacacggctgtgtattacgnggtgggacgtcccgtgctaggcctaccgtgtacgtcccgtacgtggacgtcgaagggaccttcgtcggtaccaccgttctccgacgaccgtcccctacccgaacccggaaaccgggtcccctaacggttccccgggttccccctttccccccggtcgggcccccggttacccccgttcggaccccgttaccccggaaacgggcccgacccgtaacccccgttccccggggaaaggaaccggaccccaaaaccggaccgggggacccccggggtccccggtacgggggtccctaacccggggg

SEQ ID NO: 402940 - DNA, 499 bp, Homo sapiens
  misc_feature: GZ8MTXP02IU6EN.11.13.B02.1.454.CMB.2.raw
  modified_base (318)..(318): a, c, t, g, unknown or other
  modified_base (328)..(328): a, c, t, g, unknown or other
  modified_base (361)..(361): a, c, t, g, unknown or other
  modified_base (374)..(374): a, c, t, g, unknown or other
  modified_base (399)..(399): a, c, t, g, unknown or other
  modified_base (402)..(402): a, c, t, g, unknown or other
  modified_base (405)..(406): a, c, t, g, unknown or other
  modified_base (408)..(408): a, c, t, g, unknown or other
  modified_base (410)..(410): a, c, t, g, unknown or other
  modified_base (413)..(413): a, c, t, g, unknown or other
  modified_base (487)..(487): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccgttcaccatctccagagacaacgccaaagaatgcgatatatctacagatgaacagcctgcgagccgaggacacggctgtgtattacngtgggatccnggctgcactgatccgacgtggagtcagggactntggcaccgtctcnagcctccacaggccatcgtctcccngcnccnncncngancactcgagagcacagcgccgtggctgccgtggacaaaggacctacttccgtactcctctcgcgtcgacgccggngtcggcaaggcg

SEQ ID NO: 402941 - DNA, 594 bp, Homo sapiens
  misc_feature: GZ8MTXP02JZ93M.11.13.B02.1.454.CMB.2.raw
  modified_base (268)..(268): a, c, t, g, unknown or other
  modified_base (342)..(342): a, c, t, g, unknown or other
  modified_base (478)..(478): a, c, t, g, unknown or other
  modified_base (523)..(523): a, c, t, g, unknown or other
  modified_base (548)..(548): a, c, t, g, unknown or other
tcagcgagagataccacgaccggtgctcgatttagtctagcgactttgggttctccttgttgctattttagaaggtgtccagtgtgagtcgcagatgggtggggtctggggggaggcttggtccagcctgggggggtccctgagactctcctgtacagcctctggattcagcatcagttcgtattggatgaattgggtccgccaggctccgaggggaaggggctgggagtgggtggccaaacataaagccagatggagtagtaaaacngtatgtagactctggtggagggtccggttcaccatcctccagagacaacgccaaagaatgacgatatatactanagatagaacagcctgaccgacgccgaggacacggctgtgtattacgtggtgggactcccgtagggctcggccaccgtgtaacgtccgtaccggttggacgtcgacgggtaactcgtcggtcctaccgtcctccgtnacgccctaccgaaccgaacgggcccagttcccgtccttcccccgngcccgcctgacccgtcgaacggccnccacccgtccgaagcgaccgacgtcggcccggccgtcgggctccgg

SEQ ID NO: 402942 - DNA, 621 bp, Homo sapiens
  misc_feature: GZ8MTXP02GL698.11.13.B02.1.454.CMB.2.raw
  modified_base (238)..(238): a, c, t, g, unknown or other
  modified_base (263)..(263): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaagttgggtccgccaggctccgagggaagggctgggagtgggtggccaanataaagcagatggaggtagaaaacngtatgtagactcgtggtggacgggccggttcaccatcaccagagaacaacgccaaagaatgacgatatatctaacagatagaacagcctgcgacgccgaagacgacggctgtgtattacgtggtaggggacgttcccgtggtctggcctacctgtacgtccgacgtttaggacgtacgaggggtaacctcgtcggtacctaccgttctcccgtcaccgccctacccgaaccgtaacgggccccagttcccggtcccttcccccgtggcccctcccggttcgcctcccggaggaccgcccgtacccgtccggacgaacgaccgaacggaccgggtcccggcccgtcggggtcctccggg

SEQ ID NO: 402943 - DNA, 600 bp, Homo sapiens
  misc_feature: GZ8MTXP02ICMJI.11.13.B02.1.454.CMB.2.raw
  modified_base (267)..(267): a, c, t, g, unknown or other
  modified_base (307)..(307): a, c, t, g, unknown or other
  modified_base (338)..(338): a, c, t, g, unknown or other
  modified_base (350)..(350): a, c, t, g, unknown or other
  modified_base (388)..(388): a, c, t, g, unknown or other
  modified_base (404)..(404): a, c, t, g, unknown or other
tcagcgagagataccacgaccggtgctcgatttagtctagcgactttgggttctccttgttgctatttttagaaggtgtccagtgtgaggcgcagatgggtggggtctggggggaggcttggtccagcctgggggggtccctgagactctcctgtacagcctctggattcagcatcagttcgtattggatgaattgggtccgccaggctccgaggggaagggctggagtgggtggccaacataaagccagatggaggtagtaaaacngtatgtagactctggtggagggccgttcaccatctcaganacaacgccaaagaatgacgaatatatactanaagatagaaacncgctggccgagccgaggacacggcttgtcgtatttacnggtcgggacttcccgngcgtgccacgtgtactcccggtacgttggacgtcgaagggactcgtggtccctacgtctcctacacgtccctaccgaccgaacgggcccctacgttcccgggttcccttcccccgtcggcccgtccccgtcggtccctacgagggaccctcccacccgtccgaagccgcaacgcggcccggccgtcgggtcctcgg

SEQ ID NO: 402944 - DNA, 554 bp, Homo sapiens
  misc_feature: GZ8MTXP02FNL79.11.13.B02.1.454.CMB.2.raw
  modified_base (235)..(235): a, c, t, g, unknown or other
  modified_base (262)..(262): a, c, t, g, unknown or other
  modified_base (367)..(367): a, c, t, g, unknown or other
  modified_base (371)..(371): a, c, t, g, unknown or other
  modified_base (443)..(443): a, c, t, g, unknown or other
  modified_base (500)..(500): a, c, t, g, unknown or other
tcagcgagagataccacgaccggtgctcgatttagtctagcgactttgggttctccttgttgctattttagaaggcgtccagtgtgaggcgcagatggtggggtctgggggaggcttggtccagcctggggggtccctgagactctcctgtacagcctctggattcagcatcagttcgtattggatgaattgggtccgccaggctccgagggaaggggctggagtgggtgccaanataaagccagatggaggtagtaaaacngtatgtaagactcgtggtggacgggccgttcaccatctccagagacaacgccaaagaatgcatatatctacagatgaaacagcctgccgagccgaggacacggtntgtntattgtggtaggctccgtgcgtgctacgtgtacgtccggtacgtggacgtacgacggtactcgtcggtaccncccgttctccacgcgtcccaccaccgacggcctacgtccgtccctccccgtcgcccnccgtgcctcgacgcaccgaccgcgacgcgcacgtaccggcgtccggcggtcgcg

SEQ ID NO: 402945 - DNA, 662 bp, Homo sapiens
  misc_feature: GZ8MTXP02GL02S.11.13.B02.1.454.CMB.2.raw
  modified_base (236)..(236): a, c, t, g, unknown or other
  modified_base (259)..(259): a, c, t, g, unknown or other
  modified_base (271)..(271): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagcctggggggtccctgagactctcctgtacagcctctggattcagcatcagttcgtattggatgaattgggtccgccaggctccgaggggaagggctggagtgggtgccaanataaagcagatggagtataaacngtatgtagactntggtggagggccgttcaccatcacgagagacaacgacaaagaatgacgtatatatctacgagatagaacagcctgaccgacgccgagacacggcttgtgtattacgtggtcgggactcccgtggctgcctacctgtacgtcccgtacgttaggcgtacgagggtactcgtcggtcctacccgtccgttaccctcgacctccccgtaccaaccccgaaaccgggccccctaggttccccggttcccccttcccccggtcgggtcccccgaccccctttcggccccgttacccggacggggtacccgacccgtaaccccggtacccggacggaaccgaaccctaaccgggacccggggcccccggtcccgggtccggggtccttaccccgggg

SEQ ID NO: 402946 - DNA, 656 bp, Homo sapiens
  misc_feature: GZ8MTXP02HHIEP.11.13.B02.1.454.CMB.2.raw
  modified_base (202)..(202): a, c, t, g, unknown or other
  modified_base (269)..(269): a, c, t, g, unknown or other
  modified_base (363)..(363): a, c, t, g, unknown or other
  modified_base (397)..(397): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccncaggctccgaggggaagggctgggagtgggtgaccaaacataaagccagatgggacgtagtaaaacngtatcgtagactgtggtggacgggtccgttcacctatcctaccagacgaacaacgacaaagaatgacgtaatatatctaacagtatacgaaacnggcctagacccggagccggaaggacgaccggttnttaggtagttacgttacggtgggtcgggtaccgtccggtgggtccgtacgtcctacgtacgtacgtccggtacggtggacgtacgaacggtactcgtcgtacctccgttcctcctacgaccgtacccgtaaccgaaccggtaccggcccgttacgttcccggtccccttcccgtcgccccgtaccgtcgaccgtacggacggaccgacccgtaccgacgagaaccgacgaccggccggttccgccggtcggtccgacgg

SEQ ID NO: 402947 - DNA, 609 bp, Homo sapiens
  misc_feature: GZ8MTXP02JTCH9.11.13.B02.1.454.CMB.2.raw
  modified_base (215)..(215): a, c, t, g, unknown or other
  modified_base (460)..(460): a, c, t, g, unknown or other
tcagcgagagataccacgaccggtgctcgatttagtctagcgactttgggtcgtgggggaggcttggtccagccgtggggggtccctgagactctcctgtacagcctctggattcagcatcagttcgtattggatgaattgggtccgccaggctccgaggggaaggggctgggagtgggtcggccaacataaagccagatggaggtagtaaaacngtatgtagactcgtggtgggacggggtccgttcaccatctccagagacaacgccaagatgcgatatatctacagatgaacagcctggcgacgccgaggacacggtctgtgtattacgtggtgggacgtccgtggctggctacctgtactccgtacgttggacgtcgagggactcgtggtccaccgtctaccgtcacgtcctacccgaacccgaacgggcccctagttcccgtcccctttccccgnggtccccgccctacgccctaccggaggtccaccacccgtacggaacgacgccaacgcgccggacccgtccggggtcgtaccgccgtacggtcggaccgtacggtacctccgtaccgtctcctcgtgcgtcggcggcgtcgacggcggag

SEQ ID NO: 402948 - DNA, 595 bp, Homo sapiens
  misc_feature: GZ8MTXP02F2HBR.11.13.B02.1.454.CMB.2.raw
  modified_base (261)..(261): a, c, t, g, unknown or other
  modified_base (280)..(280): a, c, t, g, unknown or other
  modified_base (294)..(294): a, c, t, g, unknown or other
  modified_base (349)..(349): a, c, t, g, unknown or other
  modified_base (543)..(543): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctgggggggtccctgagactctcctgtacagcctctggattcagcatcagttcgtattggatgaattgggtccgccaggctcgaggggagggctggagtgggtgccaacataaagcagatggaggtataaaacngtatgtagactctggtggngggtccgttcaccntcctccagacgacaacgaccaaagaatgacgtataatatctaacagatagaaacngccctggccgacgccggaggacgacggtctgtgtacttacgtggtcggggtacgtccgtgggctggctaccgtgtaactcccggtacgttggacgtgacgggtactcgtcgacctaccgtcctctccgacgccctaccaaccgacggccctagtcccgtccctaccccgtggcccgcctgcctccgagggaccnccctacccggcgaacgaacgccgaacgcgggcccgtccggtcggcctaccgg

SEQ ID NO: 402949 - DNA, 575 bp, Homo sapiens
  misc_feature: GZ8MTXP02FRITH.11.13.B02.1.454.CMB.2.raw
  modified_base (239)..(239): a, c, t, g, unknown or other
  modified_base (277)..(277): a, c, t, g, unknown or other
  modified_base (298)..(298): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagcctggggggtccctgagactctcctgtacagcctctggattcagcatcagttcgtattggatgaattgggtccgccaggctccgaggggaaggggctggagtgggtggccaanataaagccagatggaggtgtaaaacagtatgtagactntgtggagggccgtcaccatcnccagagacaacgccaaagaatgcgatatactcaacagatagaaacagcctgaccgagccgaggacacggcttgtgtattacgtggtgggactccgtgggctggcacctgtactccggaaccgttggagtcgagggtaactcgtcggtcacccgtctccctcacgccctaccaacccgaaacgggcccaagttccggtcccttcccccgtcgggcccgtcccctggcctcccgaggacgccaccgtccgagaacgcaacgcgccgcccgtcgggctcg

SEQ ID NO: 402950 - DNA, 610 bp, Homo sapiens
  misc_feature: GZ8MTXP02FFN47.11.13.B02.1.454.CMB.2.raw
  modified_base (202)..(202): a, c, t, g, unknown or other
  modified_base (259)..(259): a, c, t, g, unknown or other
  modified_base (265)..(265): a, c, t, g, unknown or other
  modified_base (278)..(278): a, c, t, g, unknown or other
  modified_base (300)..(300): a, c, t, g, unknown or other
  modified_base (532)..(532): a, c, t, g, unknown or other
  modified_base (550)..(550): a, c, t, g, unknown or other
tcagcgagagataccacgaccggtgctcgatttagtctagcgactttgggttctccttgttgctatttttagaaggtgtccagtgtgaggcgcagatgggtggggtctgggggaggcttggtccagcctgggggggtccctgagactctcctgtacagcctctggattcagcatcagttcgtattggatgaattggggtccnccaggctcgagggaagggctgggagtgggtgccaacataaacgccagatggaggtanaaaacngtatgagactcgnggtggacggccgttcaccatcncagacacaacgccaaagatgcgatatactactaacagactagaacaggtccgtgaccgacggaccgaaggccgacggtccttggttacgtactacgttggtacggggtcttccccgagggtcgttcgggacctaccgttacgtaacgttcccggtaacggttcggacgtacgaacgggtaccttcgtcggtacctcccgtctccctacaccgtccacccgaccgaacggccncgttccggtcctccccgngccgcctcgcctacgagaccgaccctcgcgagaacgcgacgtcgccgccgtcggctccgg

SEQ ID NO: 402951 - DNA, 544 bp, Homo sapiens
  misc_feature: GZ8MTXP02HKLOG.11.13.B02.1.454.CMB.2.raw
  modified_base (198)..(198): a, c, t, g, unknown or other
  modified_base (234)..(234): a, c, t, g, unknown or other
  modified_base (259)..(259): a, c, t, g, unknown or other
  modified_base (302)..(302): a, c, t, g, unknown or other
  modified_base (371)..(371): a, c, t, g, unknown or other
  modified_base (382)..(382): a, c, t, g, unknown or other
  modified_base (502)..(502): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccnccaggctccgagggaagggctggagtgggtgccaanataaagtcagatggagtataaaacngtatgtagactgtggtggacgggccgttcaccatcctacaganacaacgcaaagatgcgatatatctacagatgaacagcctgccgagccgagctacggctgtgtattacgnggtggctccgngactgcactgactccgacgtgatcgaggactcgcgtccaccgtctcctcgacgccctacgaccgaacggccacgttccggtccctccccgtagcccctccgtcgacctccgagggacccnccgaccgtcgacgcgcacggacggtcccgccggtcggctacg

SEQ ID NO: 402952 - DNA, 559 bp, Homo sapiens
  misc_feature: GZ8MTXP02GB9ML.11.13.B02.1.454.CMB.2.raw
  modified_base (264)..(264): a, c, t, g, unknown or other
  modified_base (276)..(276): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgagggaagggctggagtgggtggccaacataaagccagatggaggtagtaaaacngtatgtagactntgtggaggccgttcaccatctccagagacaacgcaaagaatgcgatatatctaacagatcgaaacagcctgccgacgccgaagacacggctgtgtatacgtgtggggatccgtggctgcacctgactccgtacgttgacggtcaacgggactgtggtcaccgtctcctcacgcctaccaccgaacggcccagtccggtccctttcccccgcggtcccgtccctcggcctccgacggacgccacccgccgagaacgcaaccgcggccgcccgtcgggactccgg

SEQ ID NO: 402953 - DNA, 581 bp, Homo sapiens
  misc_feature: GZ8MTXP02FPJ90.11.13.B02.1.454.CMB.2.raw
  modified_base (262)..(262): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaaagccagatggaggtgtaaaacngtatgtagactctgtggagggccggttcaccatctcagagacaacgcaaagaatgcgatatatctacagatgaaacagcctgccgagccgaggacacgggctgtgtattacgtgtggggagttccctgggctgggcaccgtgtatcccgacgttggaagtcgaagggaactcgtggtccaccgtctccctctcggacctccacccgaaacgggccctacgtccggttccgttccccctcgggcccgtcccctcggccctcccgacgggacgccaacccgtcccggaagaacgcaccgacggccggcccgtcgggctcgg

SEQ ID NO: 402954 - DNA, 579 bp, Homo sapiens
  misc_feature: GZ8MTXP02F0CWK.11.13.B02.1.454.CMB.2.raw
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaaagccagatggaggtgtaaaaacagtatgtagactctgtggagggccggttcaccatctccagagacaacgcaaagaatgcgaatatatctaacagatgaacagcctgcgagccgagacacggctgtgtattactggtgggatccctggctggcactgtactccgacgttggagtcgagggactctggtcacccgtctcctcagccctccacccgaaagggccccaagttccggtaccttccccccgtggcccgcccctcgcctaccgaggacgccaccctccggaagacgaccacgacggcggcccctggggcctcgcctcgggtaccaaacgggaccttaacttcccggttatccgtccttacgcttggacggcggcgtggacgaacggcg

SEQ ID NO: 402955 - DNA, 747 bp, Homo sapiens
  misc_feature: GZ8MTXP02J0HLL.11.13.B02.1.454.CMB.2.raw
  modified_base (264)..(264): a, c, t, g, unknown or other
  modified_base (304)..(304): a, c, t, g, unknown or other
  modified_base (309)..(309): a, c, t, g, unknown or other
  modified_base (336)..(336): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaagggctggagtgggtggaccaacataaagccagatggagtagtaaacngtatagtagactcgtggtggagggtccgttcacctatccncaganacaacgccaaagatgacgatatatcanagatgaacagcctagacccgagacccgatacggaccgacgggtcttggtacgttaatttaccggtgttacgggggtaccttcccggtgggtaccgtaccggggaccctaacccgttaccggtaacccgttaccccggggtaaccgggtttacggggaacgttacccgggaaacgggggttaaccttccgggtaccggtcccgtaacccgttcctcccgtacgaccgtccccgtaaacccgacccggaaccgggtccctaccgggttcccgtaccccgtttcccccggaggtcccccggtacccttcggacccgttcccggaacggttacccgacccgtaaccccgtacccggaaggtaaccacccggtaaccggacccggggtccccggtaccccgggtcggggtaccccg

SEQ ID NO: 402956 - DNA, 628 bp, Homo sapiens
  misc_feature: GZ8MTXP02FXF09.11.13.B02.1.454.CMB.2.raw
  modified_base (223)..(223): a, c, t, g, unknown or other
tcagcgagagataccacgaccggtgctcgatttagtctagcgactttgggtctgggggaggcttggtccagcctgggggggtccctgagactctcctgtacagcctctggattcagcatcagttcgtattggatgaattgggtccgccaggctccgagggaaggggctggagtgggtggccaacataaagccagatggaggtagtaaaacagtatgtagactntggtggagggccgttcaccatctccagagacaacgcaagaatgcgatatatctacagatagaacagcctggcgagccgaggacacggctgtgttattacgtggtgggacgtcccgtggctggcctaccgtgtacgtcccgtacggttggacgtcgagggactcgtcggtcctacccgtctcctcacgccctaccgacccgacggggacccctacgttcccgttccccgttcccccgcggtccccgtccccgtcgccctaccgacggacgccctacccgtccggaacgacgaccgacgccggccggtcccggtcgggccgtcgtacccgtcggtacggaacggtacccttaccgttccgttacttccgtctccgcgtcggacggtcgggtcgcggaccgaggaccg

SEQ ID NO: 402957 - DNA, 638 bp, Homo sapiens
  misc_feature: GZ8MTXP02FVIOE.11.13.B02.1.454.CMB.2.raw
  modified_base (263)..(263): a, c, t, g, unknown or other
  modified_base (391)..(391): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattggtccgccaggctccgaggggaaggggctgggagtgggtggccaacataaagccagatggagtagtaaaacngtatgtagactctgtggaggccggttcaccatctcagacgacacgacaagatgacgatatatctacatatagacagcgtgccgagccgagactacggctgtgtattacgtggtagggacgttcccggnggtctcggacctcgtcgtactcccgggtacgttggacgttacggaacggtactcggtcggttaccctacccgttctacccgtacgaccctacccgtacccgaaacccggaccggtacccttacggttccccggtccccttccccgcggtacccccgtccgttacgccctacccggaggtacccaccccgtaaccgcggaacgaaccgtaccaccggaccgggtccccggtccggcggtaccctcggg

SEQ ID NO: 402958 - DNA, 603 bp, Homo sapiens
  misc_feature: GZ8MTXP02JBC78.11.13.B02.1.454.CMB.2.raw
  modified_base (146)..(146): a, c, t, g, unknown or other
  modified_base (209)..(209): a, c, t, g, unknown or other
  modified_base (220)..(220): a, c, t, g, unknown or other
  modified_base (236)..(236): a, c, t, g, unknown or other
  modified_base (249)..(249): a, c, t, g, unknown or other
  modified_base (481)..(481): a, c, t, g, unknown or other
  modified_base (490)..(490): a, c, t, g, unknown or other
tcagcgagagataccacgaccggtgctcgatttagtctagcgactttgggtctgggggaggcttggtccagcctgggggggtccctgagactctcctgtacagcctctggattcagcatcagttcgtattggatgaattgggtccnccaggctccgagggaggggctggagtgggtggccaacataaagccagatggaggtgtaaaacngtatgtagctntggtggagggccgttnaccatctccaganacaacgcaaagatgacgatatatctaacaggatagaacagcctggaccgacggccgaggactacggctggtagttattacgtggtgggacttcccgtggctggcctacgtgtactccggacgttggacgttcgaggggtactcgtcggtcctacccgtctcctacgacgtccctaccgaacccgacggggaccctacgtcccgttcccttcccccgcggcccgacctcgtcnccgacggcnccctaccgtcgagacgccacgcgccgccgtggactcgccgtacggtacgacgtactaccgttccgtacttccgtcgtcgtcgtcggacgggccggtgtacggaccaacgggcc

SEQ ID NO: 402959 - DNA, 643 bp, Homo sapiens
  misc_feature: GZ8MTXP02IKNZU.11.13.B02.1.454.CMB.2.raw
  modified_base (264)..(264): a, c, t, g, unknown or other
  modified_base (279)..(279): a, c, t, g, unknown or other
  modified_base (304)..(304): a, c, t, g, unknown or other
  modified_base (407)..(407): a, c, t, g, unknown or other
  modified_base (503)..(503): a, c, t, g, unknown or other
tcagcgagagataccacgaccggtgctcgatttagtctagcgactttgggttctccttgttgctattttagaaggtgtccagtgtgaggcgcagatggtggggtctggggggaggcttgggtccagcctgggggggtccctgagactctcctgtacagcctctggattcagcatcagttcgtattggatgaattgggtccgccaggctccgaggggaaggggctggagtgggtgccaacataaagcagatggaggtagtaaacngtatgtagactctgnggagggtccgtcaccatctccaganaccaacgtccaaagtaatgcgtaatatatactaacagatagaaacagcctgaccccgagccgaggactacggcttgtgttattacgtgggtggggacttccgngggtctcggctacccgttgaaccgttccggaccgtttggggacgttacgaacgggggtaacttcgtacgtacccgtacccgttccttcccgtaccncccggtccctaacccgacccggaaaccgggcccctagttccccggttcccctttcccccggcggccccgcccgttcgaccctaccgaggaccgcctaacccgtccgaagcgaccacgcggccggtccgtcggggctccgg

SEQ ID NO: 402960 - DNA, 597 bp, Homo sapiens
  misc_feature: GZ8MTXP02JO7RB.11.13.B02.1.454.CMB.2.raw
  modified_base (273)..(273): a, c, t, g, unknown or other
  modified_base (282)..(282): a, c, t, g, unknown or other
tcagcgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaaagccagatggaggtgtaaaacagtatgtagactctgtggagggccgttcaccatctccagagacaacgcaagatgcatatatctanagatgaacngcctgcgagccgagacacggctgtgtattacgtggtgggacgtccctggctggccacctgtactccgtacgttggagtcgagggtaccttcgtggtcctacccgtctcctcacgccctccgacccacgggcccacgtcccgttcccttcccccgtggcccgtcccgtcgcctaccgacggtcgcctacccgtccggacgacgaccgacgaccggccggcccgtgggcctcgccgttaggtaccaacggtaccctaccgttcccggtacttccgtccgtcgtcgtcggacggcggggctcgggaccgaacgggccg

SEQ ID NO: 402961 - DNA, 592 bp, Homo sapiens
  misc_feature: GZ8MTXP02GCD7L.11.13.B02.1.454.CMB.2.raw
  modified_base (257)..(257): a, c, t, g, unknown or other
  modified_base (264)..(264): a, c, t, g, unknown or other
  modified_base (349)..(349): a, c, t, g, unknown or other
  modified_base (471)..(471): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccgaggggaaggggctgggagtgggtggccaacataaagccagatggaggtntaaaacngtatgtaagactctggtggaggggccggttcacccatcctccagagacaacgccaaagaatgcgatatatctaacagatagaacngcctgccgagccgaggacacggctgtgtattacgtggtaggggacgtcccgtgggctggctaccgtgtactccgacgttggagtcgaagggactcgtcggtaccacccggtctccctcgacnccccgtaccacccgaacgggcccctacgttcccggtccttcccccgtggcccgcccgtgcctccgaacggcgtccgaccgtaccgagaaccgacacgtacggcccgtccggcgggcctcgg

SEQ ID NO: 402962 - DNA, 748 bp, Homo sapiens
  misc_feature: GZ8MTXP02JUTWA.11.13.B02.1.454.CMB.2.raw
  modified_base (198)..(198): a, c, t, g, unknown or other
  modified_base (265)..(265): a, c, t, g, unknown or other
  modified_base (372)..(372): a, c, t, g, unknown or other
tcagcgagagataccacgaccggtgctcgatttagtctagcgactttgggttctccttgttgctattttagaaggtgtccagtgtgaggcgcagatggtggggtctgggggagcttggtccagccgtggggggtccctgagactctcctgtacagcctctggattcagcatcagttcgtattggatgaattgggtccnccaggctccgaggggaagggctgggagtgggtcgaccaacataaagccagatggaggtagtaaaacngtatgtagactcgtggtggacgggtccgttacacctatctaccgaggacgacctaacggccaaaggtaactcgacgaattacacttacgaacaggattcgaaaacgnggtccctaggaccccgacggacccggaaggggtaaccacggggttcttagggttcgttaaacgtttaccgtaggggttacgggggtaaccttcccccggtaggggtacctcggggacctaacccggttgtaaccggtcccggttaaaccggggttggaacgtacggtaacggggtaacccttcggtcggtaacccgcccgttcgtccctacgacggttccccaaccgaacccggtaacggtcccctgttccccgggtccctttacccccggcggccccgtcccgtcgtaccctaccggtacggacccgtacccgtaacccgtcggaaccgaagacccgtaaccggtccgggtcccgtaccggtcgggtcctaacgg

SEQ ID NO: 402963 - DNA, 639 bp, Homo sapiens
  misc_feature: GZ8MTXP02H0ENP.11.13.B02.1.454.CMB.2.raw
  modified_base (267)..(267): a, c, t, g, unknown or other
  modified_base (400)..(400): a, c, t, g, unknown or other
  modified_base (415)..(415): a, c, t, g, unknown or other
  modified_base (548)..(548): a, c, t, g, unknown or other
  modified_base (599)..(599): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagcctgggggggtccctgagactctcctgtacagcctctggattcagcatcagttcgtattggatgaattgggtccgccaggctccgaggggaaggggctgggagtgggtggccaacataaagccagatggaggtagtaaaacngtatgtagactctggtgggacgggtccgttcacctatcctaccgagacgaacaacgccaaaggaatgacgtaatatactctaacagatagaaacacgcctggcccgagccgaggacacggctgtgtattacgngggtgggcgtcccgngggctacggcaccgtgtaccgtccggacggtttggacgttcgaacgggtacctcgtcggtacctacccgttctcccgtccgaccgccctacccgaaccgaacgggcccttacgtcccggtccctttcccccgngggacccctcccgtagccctacggacggacgacccaccccgtacgggaacncggaccaaccggcgggcccggccgtttcgggccttaccgg

SEQ ID NO: 402964 - DNA, 706 bp, Homo sapiens
  misc_feature: GZ8MTXP02IPIJC.11.13.B02.1.454.CMB.2.raw
  modified_base (389)..(389): a, c, t, g, unknown or other
tcagcgagagataccacgaccggtgctcgatttagtctagcgactttgggttctccttgttgctattttagaaggtgtccagtgtgaggcgcagatggtggggtctggggggaggcttggtccagccgtgggggggtccctgagactctcctgtacagcctctggattcagcatcagttcgtattggatgaagttgggtcccgccaggctaccgaggggaaggggctgggagtgggtgccaacataaagccagatgggaggtagtaaacagtatagtagactcgtggtggagggccggttcacctactctaccagacgacaacgaccaaagaatgacatatatctaacagtaatcgtaaacaggcctaggacccgacgaccgacggacncgggtcttgtgtacgttacgtcgggtaggggtaccgtccgtacgggtccgtcgccgtaccgttcgtaccgtacccggtacggttacgggacggttaacggaacgggtaaccttcggtcggtacccgtaccgtacctccccgttacacccgtccccgttaaccccgacccggaaacccgggtaccccgtaacgtccccggttccccgttcccccgtccgggtccccgtcccgtcgtcccgtaccgaccggaccgacccgaccgtacccggaacggcgtaaccgaccggaccggcccggtcccggtcggcgttcccggg

SEQ ID NO: 402965 - DNA, 616 bp, Homo sapiens
  misc_feature: GZ8MTXP02GCGNE.11.13.B02.1.454.CMB.2.raw
  modified_base (202)..(202): a, c, t, g, unknown or other
  modified_base (242)..(242): a, c, t, g, unknown or other
  modified_base (270)..(270): a, c, t, g, unknown or other
  modified_base (287)..(287): a, c, t, g, unknown or other
  modified_base (489)..(489): a, c, t, g, unknown or other
  modified_base (535)..(535): a, c, t, g, unknown or other
tcagcgagagataccacgaccggtgctcgatttagtctagcgactttgggttctccttgttgctattttagaaggtgtccagtgtgaggcgcagatgggtggggtctgggggaggcttggtccagccgtggggggtccctgagactctcctgtacagcctctggattcagcatcagttcgtattggatgaattggggtcccnccaggcctccgaggggaaggggctgggagtgggtgccaanataaagccagatggaaggtagtaaaacngtatgtagactcgtggngggacgggccggttcaacccgatcctaccgaagagaaccaacggccaaagaatgacgaatatactctaacagatagaaacagcctgccgagccgagacacgctgtgtattacgtggtgggactcccgtggctgggacctaccgtgtactcccggacgtttggacgttcgaagggtacctcgtggtaccaccgttctaccctnacgtccctaccaaccgaacggcccctagtccggttcccttccccgnggccctacccgtgcctccgaagggactcccgaacccgtccgaagaacgccgaacgacggcccggtcccgtggggcctccgg

SEQ ID NO: 402966 - DNA, 710 bp, Homo sapiens
  misc_feature: GZ8MTXP02JJR9L.11.13.B02.1.454.CMB.2.raw
  modified_base (269)..(269): a, c, t, g, unknown or other
  modified_base (529)..(529): a, c, t, g, unknown or other
  modified_base (658)..(658): a, c, t, g, unknown or other
tcagcgagagataccacgaccggtgctcgatttagtctagcgactttgggttctccttgttgctattttagaaggtgtccagtgtgaggcgcagatgggtggggtctggggggaggcttggtccagccgtgggggggtccctgagactctcctgtacagcctctggattcagcatcagttcgtattggatgaattgggtccgccaggctccgaggggaagggctgggagtgggtggccaacataaagccagatgggaggtagtaaaacngtatgtagactcgtggtgggacgggccggttcaccgatcctaccaaggtacgaaccgaacgacctaaaggaaactcggacgtaattaatacttaccaaactaggaacgttacgaaaccgtacgtccgtggacccgggacggccggaacgggacgtacgggtcttggttgttaacttacggtgggtacgggtacgtccgtggcttacggctaccgtgtacgtccgtaacggttgacgtacgaacggggtactcgtcggtcncccgtctccctcaacgtccctaccgaccggtaacggcccgtacgttccggttcccccgttccccgtcggcccctaacccgtcggccgtacccggaaggcccgtacccgttaaacccggccgggaaaccnccggacccgtaaccggcccgggtacccggtcccggtcggggtaccgtcccgg

SEQ ID NO: 402967 - DNA, 573 bp, Homo sapiens
  misc_feature: GZ8MTXP02FRE0L.11.13.B02.1.454.CMB.2.raw
  modified_base (264)..(264): a, c, t, g, unknown or other
  modified_base (278)..(278): a, c, t, g, unknown or other
  modified_base (293)..(293): a, c, t, g, unknown or other
  modified_base (301)..(301): a, c, t, g, unknown or other
  modified_base (333)..(333): a, c, t, g, unknown or other
  modified_base (536)..(536): a, c, t, g, unknown or other
  modified_base (543)..(543): a, c, t, g, unknown or other
  modified_base (559)..(559): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagcctgggggggtccctgagactctcctgtacagcctctggattcagcatcagttcgtattggatgaagttgggtcccgccaggctccgaggggaagggctgggagtgggtgccaaacataaagcagatggagtataaaacngtatgagactctgnggcggcgtcacatcncagacganaacgacaagaactgcgaatatactctacaganagaacacgtcagccgacgacgagtacgacggtctgtgtatacgtggtacggtcgtccgtggtcgtacgctacgtcgactccggacgttaggcgtacgacgggtaactcgtcgtaccgacccgtctccctcgaccggtccctacccgaacccgcggtaccctcgtccggtcccttcccggcgcccgtccgcacccgtcgagccnccgaccncgagcgacacggaccncggtccgcggctcg

SEQ ID NO: 402968 - DNA, 913 bp, Homo sapiens
  misc_feature: GZ8MTXP02I7A1Z.11.13.B02.1.454.CMB.2.raw
  modified_base (260)..(260): a, c, t, g, unknown or other
  modified_base (272)..(272): a, c, t, g, unknown or other
  modified_base (351)..(351): a, c, t, g, unknown or other
tcagcgagagataccacgaccggtgctcgatttagtctagcgactttgggttctccttgttgctattttagaaggtgtccagtgtgaggcgcagatggtggggtctgggggaggcttggtccagccgtggggggtccctgagactctcctgtacagcctctggattcagcatcagttcgtattggatgaagttgggtccgccaggcctcgagggaagggctgggagtgggtgccaacataaagcagatggagtagtaaangtatgtagactntggtggacgggccgtcaccatcaccagacgacaacgacaagaactgacgtaatataactctaacagtaatacgaaaccncggcctggacccgacgaccggaaggacctaccgggtcttggtacgtttaactttaacggtcggttacgggggtaaccgttccccggtaggggtcccgtacggggcccttaaacccgttaggtacccgtttccccgggtaacccggggtttaggggtacccggtacgtaaacgggggtaaccctttccggttacgggtttacccgtacccgggtttacccttccccggttaccgaccccgttaccccggttaacccccgaaaaccccggggaaacccgggggttacccccctaacgggtttcccccggggttttacccccccgtttttaccccccccgggtaccggggttaccccccgggtttaccccccgttacgggtaccccccggtttaccccggggaaaaaccgggggttaaccccggtacccccgtaaaccccccggggttacccgggaaaacccgggtaacccgggggtaacccccgaaaacccggggtaaaccccggggggtccccccggttacccccccgggggtttaggggggaacccccctttttcccggggg

SEQ ID NO: 402969 - DNA, 440 bp, Homo sapiens
  misc_feature: GZ8MTXP01A9UHU.13.70.G04.1.454.CMB.2.raw
  modified_base (327)..(327): a, c, t, g, unknown or other
  modified_base (431)..(431): a, c, t, g, unknown or other
  modified_base (434)..(440): a, c, t, g, unknown or other
tcagtcacgtactacacgaccggtgctcgatttagtgtagtgtgaagggaaagggactagagtgggtctcagatattagtggtagtggtggtagcacatctcatgtagactccgtgaagggccggttcaccatctccagagacaattccaagaacacgatgattctgcaaatgaacagcctgagagtcgaggactcggccctttattactgtgtagaaaagactacatgacgcgcgggccttttgactacgtggggccagggaattctggtcaccgtctccctcacgccctccaccaacgggccccatcccgtcttccccctggccnccctgcctccaggcgccacctccgagacgcacagcccggccctgggctgcctgggtcaaggctacttcctagtacgtgactgacgcgggctggcaaggcgacanagnnnnnnn

SEQ ID NO: 402970 - DNA, 428 bp, Homo sapiens
  misc_feature: GZ8MTXP02GJJDB.13.70.G04.1.454.CMB.2.raw
  modified_base (338)..(338): a, c, t, g, unknown or other
  modified_base (425)..(428): a, c, t, g, unknown or other
tcagtcacgtactacacgaccggtgctcgatttagtgtagtgtgaagggaaagggactagagtgggtctcagatattagtggtagtggtggtagcacatctcatgtagactccgtgaagggccggttcaccatctccagagacaattccaagaacacgatgattctgcaaatgaacagcctgagagtcgaggactcggccctttattactgtgtgaaaagaactaccatgacgcgcgggccttttgactactggggccaggggaattctggtcaccgtctcctcagcctccaccaagggccccatcccgtcttccccctggccgccctgctccagganccacctccgagagcacagcccggccctggggctgcctggtcaggctacttccagtacgtgactgagcgggctggcaaggcgcatagnnnn

SEQ ID NO: 402971 - DNA, 383 bp, Homo sapiens
  misc_feature: GZ8MTXP01EAOK6.13.11.A11.1.454.CMB.2.raw
  modified_base (341)..(341): a, c, t, g, unknown or other
  modified_base (378)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggtcaggggaccaagctggagatcaagcgaactgtggctgcacatctgtcttcatcttcccgcatctgntagtacgtactgagcggggctgggcaaggcgcatagnnnnnn

SEQ ID NO: 402972 - DNA, 385 bp, Homo sapiens
  misc_feature: GZ8MTXP01BK4HY.13.11.A11.1.454.CMB.2.raw
  modified_base (345)..(345): a, c, t, g, unknown or other
  modified_base (381)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacactttggccaggggaccaagctggagatcaagcgaactgtggctgcaccatctgtcttccatcttcccgccatctgntagtacgtgactgagcgggctggcaaggcgcatagnnnnn

SEQ ID NO: 402973 - DNA, 336 bp, Homo sapiens
  misc_feature: GZ8MTXP01COUUK.13.11.A11.1.454.CMB.2.raw
  modified_base (241)..(241): a, c, t, g, unknown or other
  modified_base (333)..(336): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattcngtcaccagtatggaactgtggctgcaccatctgtcttcatcttcccgccatctgatagtacgtgactgagcgggctggcaaggcgcataagnnnn

SEQ ID NO: 402974 - DNA, 333 bp, Homo sapiens
  misc_feature: GZ8MTXP01DY40J.13.11.A11.1.454.CMB.2.raw
  modified_base (330)..(333): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtggctgcaccatctgtctcatcttcccgcatctgatagtacgtgactgagcggctggcaaggcgcataagnnnn

SEQ ID NO: 402975 - DNA, 511 bp, Homo sapiens
  misc_feature: GZ8MTXP01C8I3E.13.11.A11.1.454.CMB.2.raw
  modified_base (372)..(372): a, c, t, g, unknown or other
  modified_base (427)..(427): a, c, t, g, unknown or other
  modified_base (455)..(455): a, c, t, g, unknown or other
  modified_base (491)..(491): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggactccaaggatgacttccgccaacgcaagggatattacncatctctgggctccagtctgacgatgaggctgactattactggtttgacttgcanaacacgcctggatctcgactgggaaccncggttcacgttctaggtcagcccaaggcccaacccntcgcactcgttcgttccccg

SEQ ID NO: 402976 - DNA, 382 bp, Homo sapiens
  misc_feature: GZ8MTXP01ET5ID.13.11.A11.1.454.CMB.2.raw
  modified_base (341)..(341): a, c, t, g, unknown or other
  modified_base (350)..(350): a, c, t, g, unknown or other
  modified_base (377)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcacgtacactttggccaggggaccaagctggagatcaagcgaactgtggctgcaccatctgtcttcatcttcccgcatctgntagtacgtnactgagcgggctggcaaggcgcatagnnnnnn

SEQ ID NO: 402977 - DNA, 381 bp, Homo sapiens
  misc_feature: GZ8MTXP01DZH9Z.13.11.A11.1.454.CMB.2.raw
  modified_base (343)..(343): a, c, t, g, unknown or other
  modified_base (379)..(381): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaagactttgcactttattctgtcaccagtatggtaggtcaccgtacactttggccaggggaccaagctggagatcaagcgaactgtggctgcaccatctgtcttccatcttcccgcatctgntagtacgtgactgagcgggctggcaaggcgcatagnnn

SEQ ID NO: 402978 - DNA, 386 bp, Homo sapiens
  misc_feature: GZ8MTXP01D7DMD.13.11.A11.1.454.CMB.2.raw
  modified_base (345)..(345): a, c, t, g, unknown or other
  modified_base (375)..(375): a, c, t, g, unknown or other
  modified_base (381)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttccatcttcccgccatctgntagtacgtgactgagcgggctggcaaggcncatagnnnnnn

SEQ ID NO: 402979 - DNA, 381 bp, Homo sapiens
  misc_feature: GZ8MTXP01CKT4K.13.11.A11.1.454.CMB.2.raw
  modified_base (339)..(339): a, c, t, g, unknown or other
  modified_base (375)..(381): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtagtcacgtacactttggccagggaccaagctggagatcaagcgaactgtggctgcaccatctgtcttcatcttcccgcatctgntagtacgtgactgagcgggctggcaaggcgcatagnnnnnnn

SEQ ID NO: 402980 - DNA, 385 bp, Homo sapiens
  misc_feature: GZ8MTXP01BJRKX.13.11.A11.1.454.CMB.2.raw
  modified_base (344)..(344): a, c, t, g, unknown or other
  modified_base (375)..(375): a, c, t, g, unknown or other
  modified_base (380)..(385): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcaagcgaactgtggctgcaccatctgtcttccatcttcccgccatcctgntagtacgtgactgagcgggctggcaaggcgnatagnnnnnn

SEQ ID NO: 402981 - DNA, 504 bp, Homo sapiens
  misc_feature: GZ8MTXP01E1OHQ.13.11.A11.1.454.CMB.2.raw
  modified_base (486)..(486): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttctctggactccaaggatgattccgcaacgcagggatatactcatctctgggctcagtctgacgatgagctgactattactggtttgacttggcacaacacgcctggatcttcgacctgggaaccacggttcacgttcgtagtcagcccaaggccaacccntgtcactcttcgtccccg

SEQ ID NO: 402982 - DNA, 385 bp, Homo sapiens
  misc_feature: GZ8MTXP01ECO2K.13.11.A11.1.454.CMB.2.raw
  modified_base (322)..(322): a, c, t, g, unknown or other
  modified_base (347)..(347): a, c, t, g, unknown or other
  modified_base (356)..(356): a, c, t, g, unknown or other
  modified_base (382)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaaagactttgctactttatttcctgtcaccagtatggtaggtcacgtacactttggccaggggaccaagctggagatcaagcgaactgtgctgcaccatcngtcttccatcttcccgccatcctgntagtacgtnactgagcgggctggcaggcgcatagnnnn

SEQ ID NO: 402983 - DNA, 516 bp, Homo sapiens
  misc_feature: GZ8MTXP01D538C.13.11.A11.1.454.CMB.2.raw
  modified_base (190)..(190): a, c, t, g, unknown or other
  modified_base (352)..(352): a, c, t, g, unknown or other
  modified_base (354)..(354): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggtctggtatcagcagaaggcaggccacgccccctgtcctactcatctttacaaaataccaggcggccctcgtggggtccctgagcgattcctccccggctcgcctctggaaacncngtcactctgaccatcagccgggaccagcctatgatgagctgtctactctgtcagggggcgtgggacaacgagcgtgcgtggttcgggcggaggggacccaggtccgtgaccgtcgttaggtcacgcccgaggcctcgcccctgtcacttctcgttccctccc

SEQ ID NO: 402984 - DNA, 384 bp, Homo sapiens
  misc_feature: GZ8MTXP01DE16Z.13.11.A11.1.454.CMB.2.raw
  modified_base (344)..(344): a, c, t, g, unknown or other
  modified_base (380)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttcatcttcccgcatctgntagtacgtgactgagcgggctggcaaggcgcatagnnnnn

SEQ ID NO: 402985 - DNA, 388 bp, Homo sapiens
  misc_feature: GZ8MTXP01CLUL3.13.11.A11.1.454.CMB.2.raw
  modified_base (384)..(388): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttatttctgtcaccagtatggtaggtcacgtactactttggccaggggaccaagctggagatcaagcgaactgtgctgcacatctgtcttccactcttcccgccatctgaatagtacgtgactgagcgggctggcaaggcgcatagnnnnn

SEQ ID NO: 402986 - DNA, 387 bp, Homo sapiens
  misc_feature: GZ8MTXP01EEN2X.13.11.A11.1.454.CMB.2.raw
  modified_base (342)..(342): a, c, t, g, unknown or other
  modified_base (380)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcaagcgaactgtggctgcacatctgtcttcatcttcccgctatctgntagtacgtgactgacggcgggctggcaaggcgcatagnnnnnnnn

SEQ ID NO: 402987 - DNA, 509 bp, Homo sapiens
  misc_feature: GZ8MTXP01DVHLI.13.11.A11.1.454.CMB.2.raw
  modified_base (328)..(328): a, c, t, g, unknown or other
  modified_base (342)..(342): a, c, t, g, unknown or other
  modified_base (367)..(367): a, c, t, g, unknown or other
  modified_base (491)..(491): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttcnctggactccaaggntgattccgcaacgcagggatatacncatctctggctcagtctgacgatgaggctgactattactggtttgattggcacaacacgcctaggatcttcggacctgggaaccacggttcaccgttcgtaggtcagcccaaggcccaaacccnctcgcactcgttcgtccc

SEQ ID NO: 402988 - DNA, 507 bp, Homo sapiens
  misc_feature: GZ8MTXP01BIDZR.13.11.A11.1.454.CMB.2.raw
  modified_base (491)..(491): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggactccaaggatgattccgcaacgcagggatattactcatctctggctcagtctgacgatgaggctgactattactggtttgacttggcacaacaacgctaggatcgttcggacctgggaaccacggttcaccgttctaggtcagccaggccaacccnctgcactcttgtcccc

SEQ ID NO: 402989 - DNA, 335 bp, Homo sapiens
  misc_feature: GZ8MTXP01BYRB8.13.11.A11.1.454.CMB.2.raw
  modified_base (332)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtggctgcaccatctgtcttcatccttccgccatctgatagtacgtgactgagcgggctggcaggcgcataagnnnn

SEQ ID NO: 402990 - DNA, 552 bp, Homo sapiens
  misc_feature: GZ8MTXP01D4OZI.13.11.A11.1.454.CMB.2.raw
  modified_base (328)..(328): a, c, t, g, unknown or other
  modified_base (342)..(342): a, c, t, g, unknown or other
  modified_base (368)..(368): a, c, t, g, unknown or other
  modified_base (528)..(528): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggatcctccccagtttctcctgaggttcaggtcaactcagataaacgacagggctctggacgtccccagccgcttcnctggactccaaggntgactccgcaacgcagggatatactnatctcgtggctcagtctgacgatgagctagactattactggtttagacgtttggactaacaaaccgaacgccgttaggacttccgtttacggaccgttcggggaaccctacgggttcctacccgttctaacgggtccacgcccaacggccccaaaccccntcgtcactccgttcgttaaccccc

SEQ ID NO: 402991 - DNA, 505 bp, Homo sapiens
  misc_feature: GZ8MTXP01AX73I.13.11.A11.1.454.CMB.2.raw
  modified_base (219)..(219): a, c, t, g, unknown or other
  modified_base (249)..(249): a, c, t, g, unknown or other
  modified_base (295)..(295): a, c, t, g, unknown or other
  modified_base (307)..(307): a, c, t, g, unknown or other
  modified_base (451)..(451): a, c, t, g, unknown or other
  modified_base (482)..(482): a, c, t, g, unknown or other
tcagtcacgtactacacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccngcactgatgttggtgttatactatgtctcnggtatcaacaacacccaggacaaacgcccccaaactcatcatttangaagtcatttancggcctcagggtatttctaatcgtcttctctggtcctccaagtctgggaccaacacggcctcccgtgaccctatcctcgtgggccttccgaggctagaagacgagctgatttattactgcagctcatatacacatcaacgcaangttctaggagtcggaacaaacgttcaccgtntaggcacgccacggccaacccgc

SEQ ID NO: 402992 - DNA, 517 bp, Homo sapiens
  misc_feature: GZ8MTXP01BT6SC.13.11.A11.1.454.CMB.2.raw
  modified_base (285)..(285): a, c, t, g, unknown or other
  modified_base (366)..(366): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctcgaagttactctttacnggcgtctacccgggatccggggtcctgaccgattcagtggcaggcgggtctggggacagtactttcactctcaccaatccngcagccttcaggctagaagatgtggcagtttatactgtcagcaaatattatatctctcctctcggacgttcgccaagggacagggtagaatcaaacgactgtgctgcacctattcttgttcttcacttccttccccgcttatcttcgtaag

SEQ ID NO: 402993 - DNA, 531 bp, Homo sapiens
  misc_feature: GZ8MTXP01EYBXZ.13.11.A11.1.454.CMB.2.raw
  modified_base (375)..(375): a, c, t, g, unknown or other
  modified_base (512)..(512): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggacgtcctccccagtttctcctgaggttcaggtcaaactcaagataaacgacagggctctggacgtccccagccgtcttctctggactccgaaggatgacttccgacaacgcagggatatacncatctcgtggctcagtctgacgatgagctgactattactggtttgacgttggactacgaaacacgcctaggacttcgttccggacctgggaaccctcggttcaccgttcgtaggtcacgcccaacggcccaaacccnctcgcactcttcgtccccg

SEQ ID NO: 402994 - DNA, 404 bp, Homo sapiens
  misc_feature: GZ8MTXP01EWE0X.13.11.A11.1.454.CMB.2.raw
  modified_base (297)..(297): a, c, t, g, unknown or other
  modified_base (392)..(404): a, c, t, g, unknown or other
tcagtcacgtactacacgaccggtgctcgatttagctacgactgcagggccagtcaggattgtcagcagcaactacttagcctggcaccagcagaagcctggccaggcccccaggctcctcatctacgatgtattcaggaggaccactgacatcccagacaggttcagtggcagtggtctgggacagacttcactctcaccatcagcagactggaacctgaaagactttgctacttttattctgtcaccagtatggtaggtcaccgttacacttttggccaggggaccaagctgganatcaaagcgaaactgtaggcttgctaccatctgtccttcatctcccgcctaatctgatagtacgtgaactgagtcgggctggcaaggcgcatagnnnnnnnnnnnnn

SEQ ID NO: 402995 - DNA, 512 bp, Homo sapiens
  misc_feature: GZ8MTXP01DCPDQ.13.11.A11.1.454.CMB.2.raw
  modified_base (394)..(394): a, c, t, g, unknown or other
  modified_base (420)..(420): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggcagaataaatatacttcctggtatcagcagaagtcaggccagtcccctgtgctggtcatctatcaagatgccaagcggccctcgagggactcccccctgagcgtattctctggcctcaaactctgggaactcacgccactctgaccatcaggcggacccaggctangatgaggctagactatactgtcaggngtgggacagcagcaacgtcgccgtcttagtgtcgttacggacttcggggaacctaacgggtctacccgtcttaacggtcaacggtaaccccg

SEQ ID NO: 402996 - DNA, 380 bp, Homo sapiens
  misc_feature: GZ8MTXP01D7XK1.13.11.A11.1.454.CMB.2.raw
  modified_base (343)..(343): a, c, t, g, unknown or other
  modified_base (378)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgcatctgntagtactgactgagcgggctggcaaggcgcatagnnn

SEQ ID NO: 402997 - DNA, 390 bp, Homo sapiens
  misc_feature: GZ8MTXP01C6IFC.13.11.A11.1.454.CMB.2.raw
  modified_base (345)..(345): a, c, t, g, unknown or other
  modified_base (383)..(390): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcacctagtatggtagcaccgtactacttttggcagggaccaagctaggagatcaagcgaactgtggctgcaccatctgtcttccatcttcccgcatctgntagtacgtactgagcgggctgggcaaggcgacagtagnnnnnnnn

SEQ ID NO: 402998 - DNA, 526 bp, Homo sapiens
  misc_feature: GZ8MTXP01ARLZ5.13.11.A11.1.454.CMB.2.raw
  modified_base (250)..(250): a, c, t, g, unknown or other
  modified_base (291)..(291): a, c, t, g, unknown or other
tcagtcacgtactacacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtgttatactatgtctccngtatcaacaacacccaggcaaagccccaaatcatcatttangaagtcatttatcggccctcagggtatttctaactcgcttctctggtctccaagtctggcaacacggcctccctgaccatctctcgggctcgaggctagaagacgagctgattatactgcagctcatataacaacctatacaaacctacaacacggttcttacgggaaacgttcgggaaccaaacgttcaaccgttcctacggtcaacgccccgaaacggcccaacccgtaaccg

SEQ ID NO: 402999 - DNA, 385 bp, Homo sapiens
  misc_feature: GZ8MTXP01B3J6D.13.11.A11.1.454.CMB.2.raw
  modified_base (342)..(343): a, c, t, g, unknown or other
  modified_base (378)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggcctaggggaccaagctggagatcaagcgaactgtggctgcaccatctgtcttcatcttcccgcatctnntgtacgtgactgagcgggctggcaaggcgcatagnnnnnnnn

SEQ ID NO: 403000 - DNA, 384 bp, Homo sapiens
  misc_feature: GZ8MTXP01BGG67.13.11.A11.1.454.CMB.2.raw
  modified_base (372)..(372): a, c, t, g, unknown or other
  modified_base (378)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagaccggaactgaagctttgctactttattctgtcaccagtatggtaggtcaccgtacacttttggcctaggggaccaagctggagatcaagcgaaactgtggctgcaccatctgtcttcactcttccgcatctgatgtacgtgactgagcgggctggcaaggcncatagnnnnnnn

SEQ ID NO: 403001 - DNA, 514 bp, Homo sapiens
  misc_feature: GZ8MTXP01BU9W3.13.11.A11.1.454.CMB.2.raw
  modified_base (211)..(211): a, c, t, g, unknown or other
  modified_base (222)..(222): a, c, t, g, unknown or other
  modified_base (283)..(283): a, c, t, g, unknown or other
  modified_base (356)..(356): a, c, t, g, unknown or other
  modified_base (374)..(374): a, c, t, g, unknown or other
  modified_base (488)..(488): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttanacagctccganaataggaactactagcttggtaccaacagaaaccaggacagcctcgaagttactctttacnggctcgtacccgggatccggggtcctgaccgattcagtgcagcggtctggacagacttcactctcaccaatcngcagcctcaggctgaaantgtggactagtttattactgtacagtcaatattatatctcgtcctcctcggacgttcggccaagggaccagggtgaaataccgaaacgaactaagtggacctgcgactattcgngttcttcatcttccgcatcgttgtaa

SEQ ID NO: 403002 - DNA, 383 bp, Homo sapiens
  misc_feature: GZ8MTXP01EKEB7.13.11.A11.1.454.CMB.2.raw
  modified_base (344)..(344): a, c, t, g, unknown or other
  modified_base (380)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttccatcttcccgcatctgntagtacgtgactgagcgggctggcaaggcgcatagnnnn

SEQ ID NO: 403003 - DNA, 534 bp, Homo sapiens
  misc_feature: GZ8MTXP01BZOZ6.13.11.A11.1.454.CMB.2.raw
  modified_base (199)..(199): a, c, t, g, unknown or other
  modified_base (237)..(237): a, c, t, g, unknown or other
  modified_base (256)..(256): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccggnagagtgtcaccatctcttgttctggaggcagtgccaantcgggataatatgcattcnggtatcaacaactcccaggaaccggccccagactcctcatctatagcaaataacccagccggccctcgacggggtccctggacccccgattctctggctacccaagtcctggccacctcagccctcctggccatcagtggctccggtcgacgatgagctgattatactgttcagcttggatgacagcctgaatcgttgggtttcgcgggagggaccaaaggttcgacccgcccgttaggttccaagccccgaaggcctgccccccgtggttctaaccg

SEQ ID NO: 403004 - DNA, 572 bp, Homo sapiens
  misc_feature: GZ8MTXP01D6X7J.13.11.A11.1.454.CMB.2.raw
  modified_base (343)..(343): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggatcctccccagtttctcctgaggttcaggtcaaactcagataaacgacagggctctggactccccagccgcttctctggactccaaggntgatccgacaacgcagggatatactcatctctggctcagtctgacgatgaggctagacttattacgtggtttgacgtttggactaacaacaaccgtcgtagggtaacttccgtttacgggacccttggggaacccctcgggttaccacccggttccgtaacgggttccacggccccaaacgggccccaaaaccccgcttcggtaccacgttccttcgttttaacccccc

SEQ ID NO: 403005 - DNA, 384 bp, Homo sapiens
  misc_feature: GZ8MTXP01DJ9KQ.13.11.A11.1.454.CMB.2.raw
  modified_base (343)..(343): a, c, t, g, unknown or other
  modified_base (363)..(363): a, c, t, g, unknown or other
  modified_base (379)..(384): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgntagtacgtgactgagcgggntggcaaggcgcatagnnnnnn

SEQ ID NO: 403006 - DNA, 391 bp, Homo sapiens
  misc_feature: GZ8MTXP01CX34V.13.11.A11.1.454.CMB.2.raw
  modified_base (350)..(350): a, c, t, g, unknown or other
  modified_base (370)..(370): a, c, t, g, unknown or other
  modified_base (381)..(381): a, c, t, g, unknown or other
  modified_base (386)..(391): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttatttctgtcaccagtatggtagtcacgtactacgttttcggccgaggggaccaaagcgtaggagatcgaagcgaactgtggctgcacatctgtctcactctcccgcatctagntagtacgtgactgagcgggntggcaaggcgnatagnnnnnn

SEQ ID NO: 403007 - DNA, 517 bp, Homo sapiens
  misc_feature: GZ8MTXP01BV0VS.13.11.A11.1.454.CMB.2.raw
  modified_base (191)..(191): a, c, t, g, unknown or other
  modified_base (234)..(234): a, c, t, g, unknown or other
  modified_base (305)..(305): a, c, t, g, unknown or other
  modified_base (324)..(324): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgngtatggtcctggtatcaacagaaggcaggccagccccctgtcctactcatctttcaaaatccagcgccctntgggtccctgagcgattcnccggctccgctctggacacagtcactctgaccatcagcggaccagcctatgatgaggctgtctacttctgtcaggcggtgggacaacgagcgtgcgtggttcggcggtaggggaccaggtctcggtaccgttcgttaggcgacgcccgaagggccttcgccccctggtccacctcttcgttccccgccttccc

SEQ ID NO: 403008 - DNA, 718 bp, Homo sapiens
  misc_feature: GZ8MTXP01BSS0S.13.11.A11.1.454.CMB.2.raw
  modified_base (254)..(254): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatattggtaccacagagcagggagtccncccagttctcctgaggttcaggtacaaactcaagaataaacgacagggctcgtggacgtccccagccgtcttctcgtggactccgaaaggtatcgtaacgttacccgaccaacggccgaaaggggtaacttaacttaacctacaacttcctacgtcggggccttacccgaagttccttaggaaccgtaagttggaacgggtccttaggtaaaccttatttaaccgttggggttttacgtacgtttagggacctaaactaaaccgaaaccggtcccgttaggggaaccttccgggtttaccgggaacccggttaccggggaaacccctaaccgggggttaccctaaaccccggttcccgttaacggggtacccaacccgggttaccccgaaaaccgggtaacccccaaaacccccgtaactttcggaccccttaaccttcccgttaaccgttttaaccccccccg

SEQ ID NO: 403009 - DNA, 345 bp, Homo sapiens
  misc_feature: GZ8MTXP01DSLG8.13.11.A11.1.454.CMB.2.raw
  modified_base (341)..(345): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaaacctgaagtactttgctacttttattctgtcaccagtatggaactgtggctgacaccatctgtcttcacttcttcccgcctattctgatagtacgtgactgacgcggtctggcaaggcgcatagnnnnn

SEQ ID NO: 403010 - DNA, 535 bp, Homo sapiens
  misc_feature: GZ8MTXP01EXRV5.13.11.A11.1.454.CMB.2.raw
  modified_base (259)..(259): a, c, t, g, unknown or other
  modified_base (343)..(343): a, c, t, g, unknown or other
  modified_base (513)..(513): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccgacagaagccagggagtccnccccagttctcctgaggttcaggtcaaactcagataaacgacagggctctggacgtccccagccgcttctctggactccaaggntgacttcccgcaacgcagggatattactcatctcgtgggctcagtctgacgatgagctgactattactggtttgacttggactacgaaaccacgcctaggactcgttcggacctggggaaccctacgggttccaccggttctagggtccacgcccaaggcccaaaccccntcgtcacttccttcgtaacccc

SEQ ID NO: 403011 - DNA, 536 bp, Homo sapiens
  misc_feature: GZ8MTXP01DZWAD.13.11.A11.1.454.CMB.2.raw
  modified_base (474)..(474): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtccctatgacatatattggtaccgacagaagccagggagtccctccccagtttctcctgaggttcaggtcaaactcagataaacgacagggctcgtggacgtccccagccgtcttctctggactacccgaaaggatgacttcccgccaacgcgaaggggaattacttaactcatctcgtgggctccgagtctagacgatgaggctgactattactggtttgattgcacaacacgcctaggatcgtcgactgggaaccncggttcaccgttcgtaggtcacggcccaggcccaacccaactcgtcactccttcgttccccg

SEQ ID NO: 403012 - DNA, 506 bp, Homo sapiens
  misc_feature: GZ8MTXP01DGQU3.13.11.A11.1.454.CMB.2.raw
  modified_base (344)..(344): a, c, t, g, unknown or other
  modified_base (368)..(368): a, c, t, g, unknown or other
  modified_base (390)..(390): a, c, t, g, unknown or other
  modified_base (421)..(421): a, c, t, g, unknown or other
  modified_base (452)..(452): a, c, t, g, unknown or other
  modified_base (488)..(488): a, c, t, g, unknown or other
  modified_base (498)..(498): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaaggntgattccgcaagcagggatatacncatctctggctcagtctgacgntgaggctgactattactggtttgacttgcanaacacgctggatcgttcggacctgggaaccnggttcaccgttctaggtcagcccaaggcccaacccntcgtcactcncgttcccc

SEQ ID NO: 403013 - DNA, 390 bp, Homo sapiens
  misc_feature: GZ8MTXP01A57ZY.13.11.A11.1.454.CMB.2.raw
  modified_base (385)..(390): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaaagtctttgctacttttattctgtcaccagtatggtaggtcaccgtactactttggccaggggaccaagctggagatcaagcgaactgtggctgcaccatctgtcttcatcttcccgcatctgaactagtacgtgactgagcgggctggcaaggcgcagtagnnnnnn

SEQ ID NO: 403014 - DNA, 384 bp, Homo sapiens
  misc_feature: GZ8MTXP01EBE0B.13.11.A11.1.454.CMB.2.raw
  modified_base (341)..(341): a, c, t, g, unknown or other
  modified_base (378)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggcacgtacactttggccaggggaccaagctggagatcaagcgaactgtggctgcaccatctgtcttcatcttcccgcatctgntagtacgtgactgagtcgggctggcaaggcgcatagnnnnnnn

SEQ ID NO: 403015 - DNA, 534 bp, Homo sapiens
  misc_feature: GZ8MTXP01ECW29.13.11.A11.1.454.CMB.2.raw
  modified_base (294)..(294): a, c, t, g, unknown or other
  modified_base (334)..(334): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagtttctcctgaggttcaggtcaaactnagataaacgacagggctcgtggacgtccccagccgcttcnctggactcaaggatgaacttccgcaaacgcagggatatactcatctcgtgggctcagtctagacgtatgaggctagacttattacgtgtttgacttggactacaaacaacgcctaggtactcgttcggaccgtggaccacggtcaccgtccgtaggttccacgacccaaggcccaaccgctcgttctaacgttcgtcccg

SEQ ID NO: 403016 - DNA, 514 bp, Homo sapiens
  misc_feature: GZ8MTXP01EEN0P.13.11.A11.1.454.CMB.2.raw
  modified_base (212)..(212): a, c, t, g, unknown or other
  modified_base (223)..(223): a, c, t, g, unknown or other
  modified_base (248)..(248): a, c, t, g, unknown or other
  modified_base (281)..(281): a, c, t, g, unknown or other
  modified_base (466)..(466): a, c, t, g, unknown or other
  modified_base (502)..(502): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttanacagctccganaataggaactatagcttggaccaanagaaaccaggacagcctcgaagttctctttacnggctcgtacccgggatcccggggtcctgaccgattcgagtcggcaggcgggtctggggacagtactttcactctcaccaatcaagcagtccttcaggctagaagatgtaggctagtttaattctgtcagacaatatatatctctctctcgacgtcgcgaacggcgaggtgaatacaaacgaatgngctgcacattcgttcgttcttcacttcctcccgacncttcttcgtaag

SEQ ID NO: 403017 - DNA, 386 bp, Homo sapiens
  misc_feature: GZ8MTXP01EVL3Z.13.11.A11.1.454.CMB.2.raw
  modified_base (341)..(341): a, c, t, g, unknown or other
  modified_base (377)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggcaccgtacactttggccaggggaccaagctggagatcaagcgaactgtggctgcaccatctgtcttcatctcccgcatctgntagtacgtgactgagcgggctggcaaggcgcatagnnnnnnnnnn

SEQ ID NO: 403018 - DNA, 386 bp, Homo sapiens
  misc_feature: GZ8MTXP01BPKLZ.13.11.A11.1.454.CMB.2.raw
  modified_base (341)..(341): a, c, t, g, unknown or other
  modified_base (373)..(373): a, c, t, g, unknown or other
  modified_base (375)..(375): a, c, t, g, unknown or other
  modified_base (378)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcacgtacacttttggcctagggaccaagctggagatcaagcgaactgtggctgcaccatctgtctccatctcccgcatctgntagtacgtgactgagcgggctggcaaggcgananagnnnnnnnnn

SEQ ID NO: 403019 - DNA, 519 bp, Homo sapiens
  misc_feature: GZ8MTXP01DB3AT.13.11.A11.1.454.CMB.2.raw
  modified_base (281)..(281): a, c, t, g, unknown or other
  modified_base (469)..(469): a, c, t, g, unknown or other
  modified_base (478)..(478): a, c, t, g, unknown or other
  modified_base (503)..(503): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccgacaataggaactactagcttggaccaacagaaacaggacagcctcgaagttactctttacnggcgtcgtacccggatcccgggtccctgaccgatcagtggcaggcgggtctgggacagtacttcactctcaccaatcaagcagcccttcgagctagaagatgtggctagtttatactgtcagcaattattatatctctcctcctcggacgttcgaccaagggaccgagggtgaaatacaaacgactgngctgctacnttcttgttcttcacttcgttccccncttactcgttgtaacg

SEQ ID NO: 403020 - DNA, 527 bp, Homo sapiens
  misc_feature: GZ8MTXP01EDEWP.13.11.A11.1.454.CMB.2.raw
  modified_base (272)..(272): a, c, t, g, unknown or other
  modified_base (378)..(378): a, c, t, g, unknown or other
  modified_base (489)..(489): a, c, t, g, unknown or other
  modified_base (507)..(507): a, c, t, g, unknown or other
tcagtcacgtactacacgaccggtgctcgatttagctacgactgcgggggtaagaggttgtgtccaccatggcctggactcctctcctcctcctgctcctctctcactgcacagcttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttcncctgaggttcaggtcaaactcagataaacgacagggctctggacgtccccagccgtcttctctggactcgaaggatgaacttcccgccaacgcgagggatattacncatctcgtgggctccagtctgacgatgaggctgacttattacgtgtttgacttggcacaacaacgcctggactcgttcggacctgggaccacggtccaccgtctagttccngcccaaggcccaacccgntcgactaaccttcgttcccg

SEQ ID NO: 403021 - DNA, 522 bp, Homo sapiens
  misc_feature: GZ8MTXP01A6TXK.13.11.A11.1.454.CMB.2.raw
  modified_base (330)..(330): a, c, t, g, unknown or other
  modified_base (371)..(371): a, c, t, g, unknown or other
  modified_base (500)..(500): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggatccctccccagttctcctgaggttcaggtcaaactcagataaacgcagggctctggacgtccccagccgcttcnctggactccaaggatgattccgcaacgcaagggatattacncatctctgggctccagtctgacgatgaggctgactattactggtttgacttggctaacaacaacgctaggatccttcggacctggggaaccaggttcaccgttctaggtcacgcccaacggccaacccnctcgtcactcgttaacgtcccc

SEQ ID NO: 403022 - DNA, 335 bp, Homo sapiens
  misc_feature: GZ8MTXP01A66ZZ.13.11.A11.1.454.CMB.2.raw
  modified_base (326)..(326): a, c, t, g, unknown or other
  modified_base (333)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctatgatgtattcaggaggaccactgacatcccagacaggttcagtggcagtgggtctgggacagacttcactctcaccatcagcagactggaacctgaagactttgctactttattctgtcaccagtatggaactgtggctgcaccatctgtcttcatcttcccgcatctgatagtacgtgactgagcgggcctggcaaggcncaatagnnn

SEQ ID NO: 403023 - DNA, 382 bp, Homo sapiens
  misc_feature: GZ8MTXP01D64Q7.13.11.A11.1.454.CMB.2.raw
  modified_base (342)..(342): a, c, t, g, unknown or other
  modified_base (377)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttattctgtcaccagtatggtaggtcaccgtacacttttggccaggggaccaagctaggagatcaagcgaatgtggctgcacatctgtcttcatctcccgcatctgntgtacgtgactgagcgggctggcaaggcgcatagnnnnnn

SEQ ID NO: 403024 - DNA, 506 bp, Homo sapiens
  misc_feature: GZ8MTXP01EXVWH.13.11.A11.1.454.CMB.2.raw
  modified_base (442)..(442): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttctggtatcagcagaagtcaggccagtcccctgtgctggtcatctatcaagatgccaagcggccctcgagggactcccccctgacgcgattctctgggcctaccaaactctcggggaactcacgcccactctgaccatcagcgggacccaggctagtgatgaggctgactattactgtcgaggcgtagggacagcacgnaactgcctcgttacggactgggaccaggttccaaccgtctaaggtcacgccaacggccaacccc

SEQ ID NO: 403025 - DNA, 553 bp, Homo sapiens
  misc_feature: GZ8MTXP01CNC13.13.11.A11.1.454.CMB.2.raw
  modified_base (295)..(295): a, c, t, g, unknown or other
  modified_base (363)..(363): a, c, t, g, unknown or other
  modified_base (397)..(397): a, c, t, g, unknown or other
  modified_base (418)..(418): a, c, t, g, unknown or other
  modified_base (438)..(438): a, c, t, g, unknown or other
  modified_base (452)..(452): a, c, t, g, unknown or other
  modified_base (464)..(464): a, c, t, g, unknown or other
  modified_base (471)..(471): a, c, t, g, unknown or other
  modified_base (474)..(474): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaggtgtccagtgtgaggtgcagctggtagagtcgtgggggagtgtggtacggcgtgggggtcctcagactctcctgtgcaacctctgggtcacgtcagtcacacctacatgagctgggtccncaggctccgaggggaaggggctggagtgcgttcttcttttattatagtagtggtaagtacatactcgnaagactcgtggaggggccattcacatctacaganaacaattccaaagaacacgtntagtttctacaaatgaaacngctagagacgcgancgacgacggctntactcgnggngacgagagaggtccgggaccttaacggttaacgttacgaacgctaagtcgggacggttcggtaacggggaaccgaaggg

SEQ ID NO: 403026 - DNA, 661 bp, Homo sapiens
  misc_feature: GZ8MTXP01A3DGQ.13.11.A11.1.454.CMB.2.raw
  modified_base (361)..(361): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtacctacagaagccgagggacgtccctcccctagtttcctcctggtaggttcaggtacaaactcaagaactaaacgacgagggctcgtggacgtcccagccgtcttctcgtggactaccgaaggntcgacttacccgaccaacgcgaagggtattacttactctattcgtcgtgggcctacgagtccgtagacgtagtgaggtctagtacttagtttacgttgggtttacgtacgttacggacctaaacgaaaccgacggtccgttagggtaccttccggtttaccgggacccgttcgggggaaccctccgggggttcctaaaccccgggttcgtaacgggtcccgaccggttacccccgaaaccgggaaccccaaaccccctcggttaccgtcccttaccgttcccgtttcccggttccccccg

SEQ ID NO: 403027 - DNA, 245 bp, Homo sapiens
  misc_feature: GZ8MTXP01DIKYA.13.11.A11.1.454.CMB.2.raw
  modified_base (243)..(245): a, c, t, g, unknown or other
tcagtcacgtactacacgaccggtgctcgatttagctacgactgcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 403028 - DNA, 590 bp, Homo sapiens
  misc_feature: GZ8MTXP01EJEPD.13.11.A11.1.454.CMB.2.raw
  modified_base (193)..(193): a, c, t, g, unknown or other
  modified_base (480)..(480): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgagtatggtctggtatcagcagaaggcaggcccacgccccctgtccctactctatctttacaaaactccaggccgccctcgtcgggggtccctgacgcgtacttccgtccccggcctccgcctcgtacggggaaaaccacgtaagtccaacctcctacgaaccctagtcgaacggcccggggacccaggtccctaattgaagtggagtctgtccttacttcgtgtcgaggggtcgtgggacaacgngcgtgtctgggtcggcgggacggccaggtctcgaccggttcgttaggccgacgccccgagggttccctccgggccccctcggtccacgttcctccgtttcccccaacccg

SEQ ID NO: 403029 - DNA, 379 bp, Homo sapiens
  misc_feature: GZ8MTXP01CJCUP.13.11.A11.1.454.CMB.2.raw
  modified_base (374)..(379): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctcaacagggccactggcgtcccagacaggttcactggcggtgggtctgcgacaaacttcactctcaccgtcaccagactggagcctgaagattttgcagtatattcctgtcaccagtttggtgactcaacgtggacgtcggccatgggaccaaggtggaaatgaaacgaactgtgctgcacatctgtctcatctccgcatcctgatagtactgaactgaagcgggctggcaaggcgcatagnnnnnn

SEQ ID NO: 403030 - DNA, 519 bp, Homo sapiens
  misc_feature: GZ8MTXP01ECH6E.13.11.A11.1.454.CMB.2.raw
  modified_base (223)..(223): a, c, t, g, unknown or other
  modified_base (493)..(493): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccganaataggaactactagcttggaccaacagaaaccaggacagcctccgaagttactcttttactgggcgtctacccgggaatccggggtcctgaccgattcagtggcaggcggtctggggacaggactttcactctcaccaaatcaagcagccttcgagctagaagatgtggcagtttatactgtcagcaatattatatctctcctctcggacgttcgccgaaggaaccagggtagaaagtacaaacgactaagtgactgcaccattcgttnttctcatcttcccgcttatcttgtaa

SEQ ID NO: 403031 - DNA, 609 bp, Homo sapiens
  misc_feature: GZ8MTXP01DQ1RM.13.11.A11.1.454.CMB.2.raw
  modified_base (191)..(191): a, c, t, g, unknown or other
  modified_base (219)..(219): a, c, t, g, unknown or other
  modified_base (247)..(248): a, c, t, g, unknown or other
  modified_base (251)..(251): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctcgtgganatgtattgaactaagagtatgtctgtannagnaagaagcagccacgccccctgtcctactcacttctttaacaaaactaccgacggccggtccctcgtcggggtccctgacgcgtacttccgtccccggcctccgcctacgtacgggaaaacacaacgtcaacctcgtacgaaccatacgacggaccgggaacccagtacctaattgtagtagacgcgtcgtcttacttcgttcgtcgacggggtacggtacggggaacgaaacgaacggcggtcggtcgttcggttcgggtacggggacggggaccgacgtcgtcgttaccgtcgttacggtacgacgaccgacgaccgtccgccccgtccggtctaccttccgtccgttcccgtcccg

SEQ ID NO: 403032 - DNA, 560 bp, Homo sapiens
  misc_feature: GZ8MTXP01BFKWO.13.11.A11.1.454.CMB.2.raw
  modified_base (474)..(474): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttctggtatcagcagaagtcaggccagtcccctgtgctggtcatctatacaagatgaccaagccggccctacgaggggactccccccgtggacgcgtacttccgtcgtacgggcctaccaaacgttcgtagggaacctcacgcccactctacgaccatccgacggaccgggacccaggaccgtaagtgggatagacgggctagtacctattacgtgtcgaggcgtagggacnggcacgcaacgtcgcccgtcttagtcggtcttacgggacttcggggaaccacgggtccaccggtcttaacgtccgaacgaaccccg

SEQ ID NO: 403033 - DNA, 523 bp, Homo sapiens
  misc_feature: GZ8MTXP01CVY30.13.11.A11.1.454.CMB.2.raw
  modified_base (259)..(259): a, c, t, g, unknown or other
  modified_base (344)..(344): a, c, t, g, unknown or other
  modified_base (502)..(502): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagtttctcctgaggttcaggtcaaactcagataaacgacaggctcttgacgtccccagccgcttctctggactccaaaggntgattccgacaacgcagggatatactcatctctggctcagtctgacgatgagctagactattactggtttcgactttgactacaacaacgtcctaggactcgttcggaactgggaaccacggttcaccgttcgtaggcacgcccaaggcccaaacccnctcgtcactccttcgttcccc

SEQ ID NO: 403034 - DNA, 391 bp, Homo sapiens
  misc_feature: GZ8MTXP01EPKVV.13.11.A11.1.454.CMB.2.raw
  modified_base (298)..(298): a, c, t, g, unknown or other
  modified_base (380)..(380): a, c, t, g, unknown or other
  modified_base (386)..(391): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaagtactttgctacttttattctgtcaccagtatggtaggtcaccgtacactttggcctaggggaccaaagctgganatcaagcgaactgtggctgcaccatctgtcttcatcttccgctatctgaatagtacgtgactgagcgggactggcaagggcncatagnnnnnn

SEQ ID NO: 403035 - DNA, 545 bp, Homo sapiens
  misc_feature: GZ8MTXP01A75I8.13.11.A11.1.454.CMB.2.raw
  modified_base (528)..(528): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtccctccccagtttctcctgaggttcaggtcaaactcagataaacgacagggctcgtggacgtccccagccgcttctctggacctccgaaaggatgacttcccgaccaacgcgaagggattattactcatctctgggctcgagtctgacgatgaggctgacttattactggtttgacttggactaacgaacgaacgtccgtaggacttccgtacgggacctgggaaccctacggttccaccggttcgtaaggtcacgcccaaggcccaacccntcgcactcttcgtcccc

SEQ ID NO: 403036 - DNA, 510 bp, Homo sapiens
  misc_feature: GZ8MTXP01B53Q3.13.11.A11.1.454.CMB.2.raw
  modified_base (260)..(260): a, c, t, g, unknown or other
  modified_base (344)..(344): a, c, t, g, unknown or other
  modified_base (490)..(490): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagttctcctgaggttcaggtcaaactcagataaacgacagggctctggacgtccccagccgcttctctggactccaaggntgattccgaccaacgcagggatattactcatctctgggctcagtctgacgatgagctgactattactgtttgacttggacacaacacgctggatcgtcggactgggaaccacggttcaccgttcgtaggcacgccaggcccacccnctcgcactcgttcgttcccc

SEQ ID NO: 403037 - DNA, 627 bp, Homo sapiens
  misc_feature: GZ8MTXP01EKV55.13.11.A11.1.454.CMB.2.raw
  modified_base (378)..(378): a, c, t, g, unknown or other
  modified_base (385)..(385): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccagggacgtccctcccagtttctcctgaggttcaggtcaaactcagataaacgacagggctcgtggacgtccccagccgcttctctcggactcaaggactgaaacttcccgccaacgcagggatatacncatctcnggctcgatctagacgatgaggctagtacttattacgtggtttacgactttcggacctaacgaaacgaaccgtacccgttgggtaacttcccggtttccgggaacccgttcgggggaaccccttacgggggttccccttaaacccgggttcccgtaacgggttcccaaccggacccccgaaaacggggcccccaaaacccccgtacgttcggttaccctaacccgtttccctttaacccccgg

SEQ ID NO: 403038 - DNA, 628 bp, Homo sapiens
  misc_feature: GZ8MTXP01CP9BM.13.11.A11.1.454.CMB.2.raw
  modified_base (358)..(358): a, c, t, g, unknown or other
  modified_base (423)..(423): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaagccgagggacgtccctcccctagtttcctccgtgtacggttcaggtacaaactcagaactaaacgacgagggctcgtggacgtccccagtccgtctctcgtggactccaaggntgacttcccgacaacgacagggatacttactcatctctcgggctccgagtcctaggaacgtaggngacgtactacgtaacttagtttacgttaggggtttacgtacgttacgacctaaaccgaaaccgtaccgtcgtacggtacttaccggtaccggtaccggtaccgggaaccgtaccggttaccgtacccgttaccgtacgtaccgacccgacccgaaccggtaaccccaacccgtctcgtaccttaccttcccgttccgtaaccccg

SEQ ID NO: 403039 - DNA, 401 bp, Homo sapiens
  misc_feature: GZ8MTXP01CXLEX.13.11.A11.1.454.CMB.2.raw
  modified_base (384)..(384): a, c, t, g, unknown or other
  modified_base (389)..(401): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaaacctgaagactttgctacttttattctgtcaccagtatggtaggtcaccgtactactttggcctaggggaccaagctaggagatcaagcgaaactggtggctgcacatctgtcttcactcttcccgcatcctgaatagtacgtgactgagcgggctggacaaggcganatagnnnnnnnnnnnnn

SEQ ID NO: 403040 - DNA, 537 bp, Homo sapiens
  misc_feature: GZ8MTXP01ARUZH.13.11.A11.1.454.CMB.2.raw
  modified_base (260)..(260): a, c, t, g, unknown or other
  modified_base (513)..(513): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagttctcctgaggttcaggtcaaactcagataaacgacagggctctggagtccccagccgcttctctggactccaaggatgattccgcaacgcagggatatactcatctctgggctcagtctgacgatgagctgactattactggtttgactttggactacaacaacgtcctagggactccgttacggaccttggggaaccacgggttcaacccgttcgtacggtcacgcccaacgggcccaaaccccnctcgtcacctcttcgttaaccccc

SEQ ID NO: 403041 - DNA, 384 bp, Homo sapiens
  misc_feature: GZ8MTXP01DI86W.13.11.A11.1.454.CMB.2.raw
  modified_base (341)..(341): a, c, t, g, unknown or other
  modified_base (370)..(370): a, c, t, g, unknown or other
  modified_base (376)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagcacgtactactttggcaggggaccaagctggagatcaagcgaactgtggctgcacatctgtcttccatcttcccgccatctgntagtacgtactgagcgggctggcaaggcncatagnnnnnnnnn

SEQ ID NO: 403042 - DNA, 567 bp, Homo sapiens
  misc_feature: GZ8MTXP01D3QGR.13.11.A11.1.454.CMB.2.raw
  modified_base (190)..(190): a, c, t, g, unknown or other
  modified_base (365)..(365): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaagagtatggttcctggtatcagcagaaggcaggccagccccctgtcctactcatctttacaaaataccaggccggccctcgtgggggtccctgacgcgattccgtccccggcctccgcctcgtcgggaaaaccacngtcacctctcgaccatcgagccgggacccagcctattgatgagctgtctacttctgtcgaggggcgtgggacacgagcgtgcgtgttcggcgtggacgggaccctaaggtccgttggtacccgttcgttaacgggtccacggcccgaacgggtccctccggccccccgttgggtcccttaccgttccttccggtttcccccc

SEQ ID NO: 403043 - DNA, 524 bp, Homo sapiens
  misc_feature: GZ8MTXP01BTLLT.13.11.A11.1.454.CMB.2.raw
  modified_base (260)..(260): a, c, t, g, unknown or other
  modified_base (349)..(349): a, c, t, g, unknown or other
  modified_base (431)..(431): a, c, t, g, unknown or other
  modified_base (505)..(505): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggactcccnccccagtttctcctgaggttcaggtcaaactcagaataaacgacagggctcgtggacgtccccagccgcttctcgtggactccaaaggntcgacttcccgaccaacgcgaagggatacttactcatctcgtgggctcgagtctgacgatgagctgactattacgtggtttnacgttggcaacacacgctaggatcgttcggactggccacgttcaccgttcgtaggcacgcccaggcccaacccntcgtcactcttcgttcccc

SEQ ID NO: 403044 - DNA, 549 bp, Homo sapiens
  misc_feature: GZ8MTXP01BCX4K.13.11.A11.1.454.CMB.2.raw
  modified_base (260)..(260): a, c, t, g, unknown or other
  modified_base (348)..(348): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcctccctctctgcttctcctggagcgtcagccagtctcacctgcaccttgcgcagtggcaccaatgttggtccctatgacatatattggtaccacagaagccagggactcccncccctagtttcctcctgaggttcaggtcaaactcagataaacgacagggctcgtggactcccagccgtcttctcgtggactccaaggntgactccgacaacgcgagggatatactcatctcgtggctcgagtctgacgatgagctgactattactggtttgacttggctaacaacgacgtcctaggattccgttcggaccgtggggaacctcgggttccaccgttcgtagggtaccacggcccgaacggccccaacccgtaacgttcgtcacctccttcgttaaccccc

SEQ ID NO: 403045 - DNA, 385 bp, Homo sapiens
  misc_feature: GZ8MTXP01BDM5N.13.11.A11.1.454.CMB.2.raw
  modified_base (343)..(343): a, c, t, g, unknown or other
  modified_base (373)..(373): a, c, t, g, unknown or other
  modified_base (379)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtagtcaccgtacacttttggccagggaccaagctggagatcaagcgaaactgtggctgcaccatctgtcttccatcttcccgcatctgntagtacgtgactgagcgggctggcaaggcncatagnnnnnnn

SEQ ID NO: 403046 - DNA, 566 bp, Homo sapiens
  misc_feature: GZ8MTXP01BC8AX.13.11.A11.1.454.CMB.2.raw
  modified_base (355)..(355): a, c, t, g, unknown or other
  modified_base (388)..(388): a, c, t, g, unknown or other
  modified_base (542)..(542): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaagccgagggacgtccctccccagtttctcctgagttcaggtacaaactcaagaataaacgacgagggctcgtggacgtccccagccgtcttctctggacctccgaaaggtntgacttcccgacaacgcgaagggtatacttacncattctcgtgggctcgagtctagacgatgaggctagtaacttattacgtggtttgacgttgacaacaaacgacgcctaggacttccgttacggaccgtgggaaccctacgggttccaccgttccgtaggtccacgcccaacggccccaaacccngtctcacctcttccgttaaccccc

SEQ ID NO: 403047 - DNA, 342 bp, Homo sapiens
  misc_feature: GZ8MTXP01E1XMR.13.11.A11.1.454.CMB.2.raw
  modified_base (338)..(342): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaaagtactttgctacttttatttctgtcaccagtatggaactgtggctgcacatctgtcttcatctcccgcatctgatagtacgtgactgagcgggctgggcaaggcgacagtaagnnnnn

SEQ ID NO: 403048 - DNA, 532 bp, Homo sapiens
  misc_feature: GZ8MTXP01C9BVU.13.11.A11.1.454.CMB.2.raw
  modified_base (368)..(368): a, c, t, g, unknown or other
  modified_base (512)..(512): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtacacagagccagggacgtcctccccagttctcctgaggttcaggtcaaactcagataaacgacagggctctggacgtccccagccgcttctctggactccaaggatgattccgacaacgcagggatatacncatctctggctccgagtctgacgtatgaggctgactattaactgggtttgtaacgttggactacaaacgaacgcgtacggatccgtacggaccttcgggaaccacggttccaccgttcctaggtcacgcccacggcccaacccntcgcactcttcgtaaccccc

SEQ ID NO: 403049 - DNA, 380 bp, Homo sapiens
  misc_feature: GZ8MTXP01C0XB2.13.11.A11.1.454.CMB.2.raw
  modified_base (340)..(340): a, c, t, g, unknown or other
  modified_base (376)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagcaccgtacactttggccagggaccaagctggagatcaagcgaactgtggctgcacatctgtcttcatcttcccgccatctgntagtacgtgactgagcgggctggcaaggcgcatagnnnnn

SEQ ID NO: 403050 - DNA, 542 bp, Homo sapiens
  misc_feature: GZ8MTXP01CU8YY.13.11.A11.1.454.CMB.2.raw
  modified_base (344)..(344): a, c, t, g, unknown or other
  modified_base (373)..(373): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatattggtaccgacagaagccagggacgtccctccccagtttctcctgaggttcaggtcaactcagataaacgacagggctcgtggacgtccccagccgcttctctggactccaaggntgacttcccgacaacgcagggtatatacncatctcgtgggctcagtctgacgatgaggtctgacttattacttgggtttgacgttggactacaacaacgctaggactcgttacgaccgtgggaacccacggttcaccgttcgtaggtcacgcccaaggccccaacccgtaactcgtccacctcgttccgttaaccccc

SEQ ID NO: 403051 - DNA, 520 bp, Homo sapiens
  misc_feature: GZ8MTXP01EC12M.13.11.A11.1.454.CMB.2.raw
  modified_base (189)..(189): a, c, t, g, unknown or other
  modified_base (350)..(350): a, c, t, g, unknown or other
  modified_base (352)..(352): a, c, t, g, unknown or other
  modified_base (454)..(454): a, c, t, g, unknown or other
  modified_base (499)..(499): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctggagatgtattgactaacgagtatggttcctggtatcagcagaaggcaggccagccccctgtcctatcatctttacaaatccaggcgcctcgtggggtccctgagcgattctcccccggctccgcctctcgggaaacncngtcactctgaccatcacgcgggacccagcctatgatgagctgtctacttctgtcgaggggcgtgggactaacgagcgtgcgtggttcgggcgggtaggaccnggtctgaccgtcttaggcacgccgagggcctcgcccccgtggtcncgttctcgttccccaaccccg

SEQ ID NO: 403052 - DNA, 523 bp, Homo sapiens
  misc_feature: GZ8MTXP01BVVZ1.13.11.A11.1.454.CMB.2.raw
  modified_base (466)..(466): a, c, t, g, unknown or other
  modified_base (472)..(472): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcctccctctctgcttctcctggagcgtcagccagtctcacctgcaccttgcgcagtggcaccaatgttggtccctatgacatatattggtaccacagaagccagggagtccctccccagttctcctgaggttcaggtcaaactcagataaacgacagggctctggacgtccccagccgtcttctctggactccaaggatgacttcccgaccaacgcaagggatatactcatctcgtgggctccgagtctgacgtatgaggctgacttattactggttgacgttggactacaacacgctaggatcgttcgactggaaccncgttcncgttcgaggtcacgccaggcccaacccgctcgccactccttcgttaacccc

SEQ ID NO: 403053 - DNA, 601 bp, Homo sapiens
  misc_feature: GZ8MTXP01B3QYB.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctccccagtttcctccgtggtacggttcaggtacaaactcaagataaacgacgagggctcgtagggacgtccccgagccgtcttctcgtcggactacgaaggctgaacttcccgccgaaacgcgagggtatattactcactctcgtcggtctccgagtctaggacgtagtggagtctgtacttagtttacgttgtttagtacgttcggacaacgtaacgacgtccgtggtacttccggttaccggaccgttcggggaacccttacgggtccaccgttacgtacggttccgacgccccgaacggccccaacccgtacgttcgcctaaccttccgttcccg

SEQ ID NO: 403054 - DNA, 336 bp, Homo sapiens
  misc_feature: GZ8MTXP01AHCCZ.13.11.A11.1.454.CMB.2.raw
  modified_base (333)..(336): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggaactgtggctgcaccatctgtcttcatcttcccgcatctgatagtacgtgactgagcgggctggcaaggcgcataagnnnn

SEQ ID NO: 403055 - DNA, 381 bp, Homo sapiens
  misc_feature: GZ8MTXP01EYWDI.13.11.A11.1.454.CMB.2.raw
  modified_base (341)..(341): a, c, t, g, unknown or other
  modified_base (350)..(350): a, c, t, g, unknown or other
  modified_base (376)..(381): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcacgtacactttggccaggggaccaagctggagatcaagcgaactgtggctgcaccatctgtcttcatcttcccgcatctgntagtacgtnactgagcgggctgcaaggcgcatagnnnnnn

SEQ ID NO: 403056 - DNA, 374 bp, Homo sapiens
  misc_feature: GZ8MTXP01D98GP.13.11.A11.1.454.CMB.2.raw
  modified_base (356)..(356): a, c, t, g, unknown or other
  modified_base (363)..(363): a, c, t, g, unknown or other
  modified_base (365)..(365): a, c, t, g, unknown or other
  modified_base (367)..(367): a, c, t, g, unknown or other
  modified_base (369)..(374): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaaacctgaaagactttgctacttttattctgtcacagtatggtagtcacgtactactttggccagggaccaagctggagatcaagcaatgtggctgcaccatctgtcttcatcttcccgcatctgtcgtgactgagcgggntgcgagngnanannnnnn

SEQ ID NO: 403057 - DNA, 518 bp, Homo sapiens
  misc_feature: GZ8MTXP01A29SB.13.11.A11.1.454.CMB.2.raw
  modified_base (499)..(499): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgtgtcctatgacatatattggtaccgacagaagccagggagtcctccccagttctcctgaggttcaggtcaaactcagataaacgacagggctctggacgtccccagccgcttctctggactccgaaggatgacttcccgaccaacgcagggatattactcatctctgggctccagtctgacgatgagctgactattactggtttgacttgacactaacacgccgtaggatcgttcggacctgggaaccagggccaccgttccgtaggtcacgcccaaggccctaaccnctgtccactcttcgtcccc

SEQ ID NO: 403058 - DNA, 558 bp, Homo sapiens
  misc_feature: GZ8MTXP01CHNYQ.13.11.A11.1.454.CMB.2.raw
  modified_base (263)..(263): a, c, t, g, unknown or other
  modified_base (273)..(273): a, c, t, g, unknown or other
  modified_base (385)..(385): a, c, t, g, unknown or other
  modified_base (536)..(536): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggttgtgctgactcagccgtcttccctctctgcttctcctggagcgtcagccagtctcacctgcaccttgcgcagtggcaccaatgttggtccctatgacattatattggtaccgacagaagccagggagtcccncccagtttcncctgaggttcaggtcaaactcagaataaacgacgagggctcgtcggactccccagccgtcttctcgtggactccaaaggtactgattcccgacaacgcgagggatacttacnctatctcgtggctcagtctagacatcgaggctagtacttagttactgggtttgtacgttggactaacaacgaacgtcgtaggtactcgttaccggaccgttgggaacccacggttccaccgttccgtagtcacgcccaacggccaacccgntcgccactcgttcgttaacccc

SEQ ID NO: 403059 - DNA, 397 bp, Homo sapiens
  misc_feature: GZ8MTXP01EHCUD.13.11.A11.1.454.CMB.2.raw
  modified_base (355)..(355): a, c, t, g, unknown or other
  modified_base (388)..(388): a, c, t, g, unknown or other
  modified_base (394)..(397): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaaagacttttgctacttttatttctgtcaccagtatggtaggtcaccgtacacgttttggccaggggaccaagctggagatcaagcgaactgtggctgcaccatctgtcttccattcttcccgcctagtcctgnttagtacgtgactggagcgggctggcaaggcgngatagnnnn

SEQ ID NO: 403060 - DNA, 530 bp, Homo sapiens
  misc_feature: GZ8MTXP01DH664.13.11.A11.1.454.CMB.2.raw
  modified_base (348)..(348): a, c, t, g, unknown or other
  modified_base (464)..(464): a, c, t, g, unknown or other
  modified_base (507)..(507): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtccctccccagtttctcctgaggttcaggtcaaactcagataaacgacagggctcgtggacgtccccagccgcttctctggacctccaaaggntgacttacccgcaacgcagggatatactcatctcgtgggctccagtctgacgatgagctgactattactggtttgacttgacacgaacaacgcctggactcgttcgcgtggaaccncggttctaccgttcgtaggtcacgcccaacggccccaaacccntcgaccactcttccgttaacccc

SEQ ID NO: 403061 - DNA, 335 bp, Homo sapiens
  misc_feature: GZ8MTXP01DJFYJ.13.11.A11.1.454.CMB.2.raw
  modified_base (333)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaacactgacatcccagacaggttcagtggcagtgggtctgggacagacttcactctcaccatcagcagactggaacctgaagactttgctacttttattctgtcaccagtatggaactgtggctgcaccatctgtcttcatccttcccgcatctgatagtacgtgactgagcggctcggcaggcgcataagnnn

SEQ ID NO: 403062 - DNA, 507 bp, Homo sapiens
  misc_feature: GZ8MTXP01DEVKP.13.11.A11.1.454.CMB.2.raw
  modified_base (387)..(387): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggacagataaatatacttctggtatcagcagagtcaggccagtcccctgtgctggtcatctatcaagatgccaagccggccctcgagggactccccctgagcgattctctggcctccaaactcgtgggaacctcacgcccactctgaccatcagcggaccnggctatggatgaggctgactatactgtcgaggcgtaggacagcagcaactcgccgtcttagtcgtcttacggacttcgggtaaccaaggtccaaccgtcgttaacgtccgaagaaccccg

SEQ ID NO: 403063 - DNA, 344 bp, Homo sapiens
  misc_feature: GZ8MTXP01CWD76.13.11.A11.1.454.CMB.2.raw
  modified_base (338)..(344): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggaactgtggctgcaccatcctgtcttcatccttcccgctatctgatagtacgtgactgagcgggctgggacaggcgcagtagnnnnnnn

SEQ ID NO: 403064 - DNA, 381 bp, Homo sapiens
  misc_feature: GZ8MTXP01BEQPD.13.11.A11.1.454.CMB.2.raw
  modified_base (353)..(353): a, c, t, g, unknown or other
  modified_base (370)..(370): a, c, t, g, unknown or other
  modified_base (376)..(381): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtgacgtcggcatgggaccaaggtgaaatgaaacgactgtggctgcaccatctgtcttcatcttccgcatcctgatagtacgtgaactgngcgggctgggcaaggcncatagnnnnnn

SEQ ID NO: 403065 - DNA, 566 bp, Homo sapiens
  misc_feature: GZ8MTXP01DXWS3.13.11.A11.1.454.CMB.2.raw
  modified_base (345)..(345): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtcctccccagtttctcctgaggttcaggtcaaactcagataaacgacagggctctggacgtccccagccgcttctctggactccaaaggntgattcccgacaacgcagggatagttactcatctcgtggctcagtctgacgatgaggctgacttattacgttggtttagacgtttggacctaacgaaacaacgcctagggacttccgtttacgggaccttggggaaccctacggttccacccgttccgtacggtccacggccccaaacggccccaaacccctaactcgtcaccttccttcgtttaaccccc

SEQ ID NO: 403066 - DNA, 525 bp, Homo sapiens
  misc_feature: GZ8MTXP01DCV52.13.11.A11.1.454.CMB.2.raw
  modified_base (366)..(366): a, c, t, g, unknown or other
  modified_base (441)..(441): a, c, t, g, unknown or other
  modified_base (466)..(466): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagatgtattgactaagagtatggtcctggtatcagcagaaggcaggccacgccccctgtcctactcatctttacaaaactaccaggccgccctcgtcgggggtccctgacgcgattccgtccccggcctccgcctcgtagggaaaccacngtcactctcgaccatcagccggaccagctatgatggagtctgtctacttctgtcgagggggcgtgggaacaacgngcgtgcgttggtcggcggagggccngtcgtcgaccgtcttaggcacgccgagcctcgcccctggtcacttctccgttccctccc

SEQ ID NO: 403067 - DNA, 643 bp, Homo sapiens
  misc_feature: GZ8MTXP01DQOV6.13.11.A11.1.454.CMB.2.raw
  modified_base (261)..(261): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggacgtcccnccccagtttctcctgaggttcaggtacaaactcagaataaacgacgagggctcgtggacgtccccagccgtcttctcgtggacctaccgaaaggactgtacttcccgaccaacgccgaaaggggtacttaacttacctctactcctcgtcgggtcctcccgagtcctagaacgtatggaacggcttagaaccttaatttacgttgggtttcgacgttggacaaaccgaaacgaaccgtccgtaggtacttccgttaccggaccgttcggggaaccctaccgggttccgaacccggttccgtaacgggtccaaccggccccgaaacggtaaccccaaacccctaacgtcggtaccttacccttccgttcccggtttccccccg

SEQ ID NO: 403068 - DNA, 541 bp, Homo sapiens
  misc_feature: GZ8MTXP01A731H.13.11.A11.1.454.CMB.2.raw
  modified_base (517)..(517): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgagttcaggtcaactcagataaacgacagggctcgtggacgtccccagccgcttctctggactccaggatgattccgcaacgcagggactatactcatctctggctccgagtctgacgatgagctgactattactggtttgacgtttggactaacaaacaaccgccgtaggtactccgttaccggaccgtgggaacccgacggttcgacccgttccgtaggtccacgcccaacggcccaacccncgtcgcactccgttcgttcccccg

SEQ ID NO: 403069 - DNA, 635 bp, Homo sapiens
  misc_feature: GZ8MTXP01DUA9A.13.11.A11.1.454.CMB.2.raw
  modified_base (191)..(191): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccgganagacagcctacatcacctgctctggagatgtattgactaacgagtatggtctggtatcagcagagcaggccacgcccctgtcctactcatctttacaaaactaccaggccgtcctcgtcggggtccctggacgcgtattccgtcccccggcctccgcctcgtacgggaaacccactcgtccaacgtctcgaacccacgtcgacggccggggacccacgtaccgtagtacgtagtagggcgttcgttcgttaccttcgttcgtgaccggacgggggtcggtaacggaaccgaacggtcgtcggtcgtcggttacgggtcgggaccggggacgtaccgtacggtcgtaccggttaccggttacgttacggtaccgacccggaccggacggttcccgtccccgtcccgttccggtctcccgttccgttccccgttccccgttccccg

SEQ ID NO: 403070 - DNA, 528 bp, Homo sapiens
  misc_feature: GZ8MTXP01BP7B0.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtcaaactcagataaacgacagggctcgtggacgtccccagccgcttctctggactccaaggatgattcccgccaacgcagggatattactcatctcgtgggctccagtctgacgatgaggctgactattactggtttgactttggactaacaacgaacgctaggactcgttcggacctgggaaccacggttcaccgttcgtaggtcacgcccaggcccacccgaatcgcactcgttcgtcccc

SEQ ID NO: 403071 - DNA, 383 bp, Homo sapiens
  misc_feature: GZ8MTXP01EC8F0.13.11.A11.1.454.CMB.2.raw
  modified_base (342)..(342): a, c, t, g, unknown or other
  modified_base (378)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcacgtacactttggccaggggaccaagctggagatcaagcgaactgtggctgcacatctgtcttcatcttccgcatcctgntagtacgtgactgagcgggctggcaaggcgcatagnnnnnn

SEQ ID NO: 403072 - DNA, 388 bp, Homo sapiens
  misc_feature: GZ8MTXP01A5OBU.13.11.A11.1.454.CMB.2.raw
  modified_base (361)..(361): a, c, t, g, unknown or other
  modified_base (384)..(388): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgtcggccatgggaccaaggtggaaatgaaacgaactgtggctgcaccatctgtcttcatcttcccgcctatccctgatagtacgtgaactgngcgggctgggcaaggcgcatagnnnnn

SEQ ID NO: 403073 - DNA, 383 bp, Homo sapiens
  misc_feature: GZ8MTXP01DZZUQ.13.11.A11.1.454.CMB.2.raw
  modified_base (240)..(240): a, c, t, g, unknown or other
  modified_base (291)..(291): a, c, t, g, unknown or other
  modified_base (339)..(340): a, c, t, g, unknown or other
  modified_base (376)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctactttattcngtcaccagtatggtaggtcacgtacactttggccaggggaccaagctgganatcaagcgaactgtggctgcacatctgtcttccatcttcccgcatctnntagtacgtgactgagcgggctggcaaggcgcatagnnnnnnnn

SEQ ID NO: 403074 - DNA, 517 bp, Homo sapiens
  misc_feature: GZ8MTXP01BL9EA.13.11.A11.1.454.CMB.2.raw
  modified_base (259)..(259): a, c, t, g, unknown or other
  modified_base (454)..(454): a, c, t, g, unknown or other
  modified_base (495)..(495): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagttctcctgagttcaggtcaaactcagataaacgacagggctctggacgtccccagccgcttctctggactccaaggatgattccgaccaacgcagggatattactcatctctgggctccgagtctgacgatgaggctgactattactggtttgacttggcacaacaagcctgatcgtcgactgggaacncggttcaccgttcgtaggtcacgcccgacggcccaaccccnctcgtcactcgttcgtaacccc

SEQ ID NO: 403075 - DNA, 581 bp, Homo sapiens
  misc_feature: GZ8MTXP01DMGB7.13.11.A11.1.454.CMB.2.raw
  modified_base (347)..(347): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccgacagaagccagggatccctccccagtttctcctgaggttcaggtacaactcagaataaacgacagggctcgtggacgtccccagccgcttctctggactccaaaggntgacttacccgaccaacgcagggattagttacctcatctcgtggctccagtctgacgatgagctagacttatttacgttggtttacgtacgtttggaccaacgaaaccaacggtccctagggtacttcgtttaccggaccgttcggggaacccacgggttctacccggttcgtaacggtcgaacgccccaaacgggcccaaccccgctcgtccaccttccgttcgtttcccccg

SEQ ID NO: 403076 - DNA, 666 bp, Homo sapiens
  misc_feature: GZ8MTXP01ALVX5.13.11.A11.1.454.CMB.2.raw
  modified_base (199)..(199): a, c, t, g, unknown or other
  modified_base (658)..(658): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccggnagagtgtcaccatctcttgttctggaggcagtgaccaacagtcggggaagttaattatgctattcgtggtatcaaacaacctcccaaggaaccggcccccagaccctccccatctaatagacaactaaccagccggccctcgacgggggtcccctgaccgtacttcctcgtcggcctccgaaaacgttcctcgggaccaacccttcgaccgtcccctcccgtcgggacccacgtccgacggtcgggccgttcccgggtccgaacggacgtcggacgggtccttaggtaactttacgtttacgttcgggtttaccgtaagggttccgtttaggggaacttcggaacgtacgtaccgttagtaacgtttacggtttcggggtttcgggaacgggtaacgggaccgtagttcgaccgtcccgttaggttccacggcccaggcctccgccccgttacggtccnccgttccg

SEQ ID NO: 403077 - DNA, 563 bp, Homo sapiens
  misc_feature: GZ8MTXP01CR58H.13.11.A11.1.454.CMB.2.raw
  modified_base (221)..(221): a, c, t, g, unknown or other
  modified_base (372)..(372): a, c, t, g, unknown or other
  modified_base (374)..(374): a, c, t, g, unknown or other
  modified_base (481)..(481): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtccccccggacagaccagcctacatccacctgctctgganatgtattgactaacgagtatggttcctggtatcagcagaaggcaggccacgcccccctgtccctactcatctttacaaaataccaggccggccctcgtcgggggtccctggacgcgtattccgtcccccggctccgcctcgtgggaaaccncngtccactctgaccatcacgccgggacccacggcctattgatgaggtctgtcttacttctgtcgaggggtcggtggacacgagcgtgcgtggtcggcgggaggaccgngtctcggaccgtcgttacggtcgacgttccccgacggcctccggcccccgtcgtcctaccgttccgtccgttccccgtcccc

SEQ ID NO: 403078 - DNA, 548 bp, Homo sapiens
  misc_feature: GZ8MTXP01CWQ1L.13.11.A11.1.454.CMB.2.raw
  modified_base (169)..(169): a, c, t, g, unknown or other
  modified_base (209)..(209): a, c, t, g, unknown or other
  modified_base (249)..(249): a, c, t, g, unknown or other
  modified_base (253)..(253): a, c, t, g, unknown or other
  modified_base (256)..(256): a, c, t, g, unknown or other
  modified_base (260)..(260): a, c, t, g, unknown or other
  modified_base (266)..(266): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (282)..(283): a, c, t, g, unknown or other
  modified_base (292)..(292): a, c, t, g, unknown or other
  modified_base (298)..(298): a, c, t, g, unknown or other
  modified_base (301)..(301): a, c, t, g, unknown or other
  modified_base (307)..(307): a, c, t, g, unknown or other
tcagtcacgtactacacgaccggtgctcgatttagctacgactgcaggggcctgggcctcaggaagcagcatcggaggtgcctcagccatggcatggatccctctcttcctcggcgtccttgcttactgcacaggatccgtggcctctatgagctgactcagccacctnagtgtccgtgtcccaggacagacagccagcatcactgctntaggaaataatggacagataatatactcctggtatcaganagancancacnctgtgntgtnatntanananannacacgcgcncgagcnccngagcgntctctcgctacactacgtagacacacactactctacacacacgacgacggaccgacgacgtagtagagtagtagacggtacgtacgtacttacgtacgtcgtacggtacggtacgggacgtacgacgacgacgaacgtacgccgtacgttacgttacgttacgttaccggttaaccggttacgggtaaccggtaacggtaaccgtacccgtaccgttaacgtaaccgttaaccgtaacccg

SEQ ID NO: 403079 - DNA, 617 bp, Homo sapiens
  misc_feature: GZ8MTXP01CZVMF.13.11.A11.1.454.CMB.2.raw
  modified_base (513)..(513): a, c, t, g, unknown or other
  modified_base (587)..(587): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagatgtattgactaagagtatggttctggtatcagcagaaggcaggccacgccccctgtcctactcattcttacaaactccgaggccgccctcgtcggggtccctggacgcgtacttccgtccccggcctccgcctcgtacggggaaaacccacgcgtccacctctacgacccatccgacggccgggacccaggtcctagttgaagtggacggtcttacgtccttacttctgtccgagggggtcggagggtaccaacgaggcgtggcgttacgggttcgggaccggggacggtaccnggtccgtcggacccggttcgttacgggtccacggttaccccgacgggttcccgtcccggtccccgtcggtaccncccgttccgttcccgttccccttaaccccg

SEQ ID NO: 403080 - DNA, 616 bp, Homo sapiens
  misc_feature: GZ8MTXP01C2YQY.13.11.A11.1.454.CMB.2.raw
  modified_base (291)..(291): a, c, t, g, unknown or other
  modified_base (383)..(383): a, c, t, g, unknown or other
  modified_base (408)..(408): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctcgtgggcgagagggccaccatcaactgcaagaccagccagagttgtttatacagctccgacaataggaactacttagcttaggtaccaacagaaaccaggacagcctacgtaagttacttctttacgngggcgtccgtaacccgggaacgtccccggggtccctcgaccgtatcgaggtggcaggcgggtctggggactagtacttcactctcaccatcngcacgtcccttgaggctagaaagtntggtgtactagtttattactgttacagtactaaattattagtactccgttaccttcccgtccgtaccgggtaccgttcggaacccgtaaggggacccgtaaggggtagaaaactacgaaaacgtagtggtcggctgaccctaccgtattccgttcggtttaccttcctaccttccgttacccccgcttacttccgttaaggttaaacg

SEQ ID NO: 403081 - DNA, 336 bp, Homo sapiens
  misc_feature: GZ8MTXP01BZYAC.13.11.A11.1.454.CMB.2.raw
  modified_base (333)..(336): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagtactttgctacttttattctgtcaccagtatggaactgtggctgcaccatctgtcttcatcttcccgcatctgatagtacgtgactgagcggctggcaaggcgcatagnnnn

SEQ ID NO: 403082 - DNA, 396 bp, Homo sapiens
  misc_feature: GZ8MTXP01AMCEB.13.11.A11.1.454.CMB.2.raw
  modified_base (388)..(396): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaacctgaagtactttgctacttttattctgtcacctagtatggtagtcacgtactacgtttggaccgaggggaccaagcgtggagatcaagcgaactgtggctgcaccatctgtctccactctcccgctatctgaatagtacgtgactgacgcgggctggcaaggcgacatgnnnnnnnnn

SEQ ID NO: 403083 - DNA, 591 bp, Homo sapiens
  misc_feature: GZ8MTXP01BNJ1T.13.11.A11.1.454.CMB.2.raw
  modified_base (192)..(192): a, c, t, g, unknown or other
  modified_base (219)..(219): a, c, t, g, unknown or other
  modified_base (509)..(509): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctctgganatgtattgactaacgagtatggttctggtatcagcagaagcaggccacgcccctgtcctactcatctttacaaatccgaggccgcctcgtcgggggtccctaggacgcgtacttccgtcccccggcctccgcctcgtacggggaaaaccacgcgtccaaccgtctcgaaccctagtccgacgggcccgggacccaggtacctagttcgagtggacggtctcgtcttacttcgtgtcgagggggcggtagggaacacgagtcgtgtcgtcggtcgggcgggacggtaccgnggtcgtcgaccggttgttacggtccacgcccgaggcctccggccccgtcggtcctaccgttcctcccgttcccctaaccccg

SEQ ID NO: 403084 - DNA, 533 bp, Homo sapiens
  misc_feature: GZ8MTXP01A6QOL.13.11.A11.1.454.CMB.2.raw
  modified_base (512)..(512): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggatccctccccagttctcctgaggttcaggtcaaactcagataaacgacagggctcgtggacgtccccagccgtcttctcgtggactccgaaggatgattcccgaccaacgcagggatatactcatctcgtggctccagtctgacgatgaggctgactattactggtttgactttggactaacaacgaacgcctaggacttcgtcggaccgtgggaaccaacggttcaccgttcgtagggtcacgcccaggcccacccnctcgcactcttcgttaacccc

SEQ ID NO: 403085 - DNA, 625 bp, Homo sapiens
  misc_feature: GZ8MTXP01D03D3.13.11.A11.1.454.CMB.2.raw
  modified_base (190)..(190): a, c, t, g, unknown or other
  modified_base (212)..(212): a, c, t, g, unknown or other
  modified_base (509)..(509): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctntggagatgtatgactaagagtatggtctggtatcgagcagagcacggccacgccccctgtcctactcattcctttacaaaacttccgaggccgtccctcggtccgggggtccctggacgcgtacttccgtccccggcctccgccgtccgtacggggaaaaccacgtaacgtccaacttccgtacggaaccctatccggacggcccggggaacccaggtccctagttgagtggacggtcttgttcttacttctgtcgagggggcgtagggaacacgagcgtgcgttacgggtccgggngggacgggaccctaggtccgtggttacccggttcgtttacgggcctacggacccgaggttcccgtccgtcccccgtgggtccctaccgttccgttccccgttccccgttaaccccg

SEQ ID NO: 403086 - DNA, 514 bp, Homo sapiens
  misc_feature: GZ8MTXP01CCRFK.13.11.A11.1.454.CMB.2.raw
  modified_base (344)..(344): a, c, t, g, unknown or other
  modified_base (373)..(373): a, c, t, g, unknown or other
  modified_base (459)..(459): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgcagggctctggacgtccccagccgtcttctctggactccaaggntgactccgcaagcagggatatactcatcnctggctccagtctgacgatgaggctgactattactgggtttgactttggacaacaacgaacgcctggatcgtcggactgggaaccnggttcaccggttctaggtcacgccacggccacccgctcgtcactcttcgttcccc

SEQ ID NO: 403087 - DNA, 384 bp, Homo sapiens
  misc_feature: GZ8MTXP01ECB63.13.11.A11.1.454.CMB.2.raw
  modified_base (343)..(343): a, c, t, g, unknown or other
  modified_base (379)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttattctgtcaccagtatggtaggtcaccgtacacttttggcctaggggaccaagctggagatcaagcgaactgtggctgcacatctgtctcatctcccgccatctgntagtacgtgactgagcgggctggcaaggcgcatagnnnnnn

SEQ ID NO: 403088 - DNA, 520 bp, Homo sapiens
  misc_feature: GZ8MTXP01CW4K5.13.11.A11.1.454.CMB.2.raw
  modified_base (259)..(259): a, c, t, g, unknown or other
  modified_base (310)..(310): a, c, t, g, unknown or other
  modified_base (344)..(344): a, c, t, g, unknown or other
  modified_base (500)..(500): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagtttctcctgaggttcaggtcaaactcagataaacgacagggctcnggacgtccccagccgcttctctggactccaaggntgattccgaccaacgcagggatatactcatctctggctcagtctgacgatgagctgactattactggtttgactttggcaacaacaacgcctaggatcgttcggacctggaaccacggttcaccgttcgtaggtcacgcccaaggcccaaaccccntcgtcacctcttcgttcccc

SEQ ID NO: 403089 - DNA, 526 bp, Homo sapiens
  misc_feature: GZ8MTXP01AU50P.13.11.A11.1.454.CMB.2.raw
  modified_base (196)..(196): a, c, t, g, unknown or other
  modified_base (472)..(472): a, c, t, g, unknown or other
tcagtcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgctccaggggaaangccaccctctcctgcagggccagtcagattgcagcagcaactacttagcctggtaccagcagaagcctggccaggcccccaggctcctcatctacgatgtattcaggagaccatgacatcccagacaggttcagtcggcagtgggtctgggaacagcttcactctcacatcagcagactggaacctgaagtactttgctactttattctgtctaccaggtactggtacgtctaccgtactacgtttggacctagggggacctaagccgtagggaanacttcaaaggcgtaaacgtggttaggcttgcaccaatctgttcttcaattcccg

SEQ ID NO: 403090 - DNA, 596 bp, Homo sapiens
  misc_feature: GZ8MTXP01D62Y1.13.11.A11.1.454.CMB.2.raw
  modified_base (243)..(243): a, c, t, g, unknown or other
  modified_base (338)..(338): a, c, t, g, unknown or other
  modified_base (354)..(354): a, c, t, g, unknown or other
  modified_base (382)..(382): a, c, t, g, unknown or other
  modified_base (450)..(450): a, c, t, g, unknown or other
  modified_base (568)..(568): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggactccctccccagtttctcctgaggttcaggtcaaactcagaataaacgacgagggctcgtggacgtccccagcccgtcttcncgtggactccgaaggntgactcccgacaacgcagggatagtacncatctcgtggctccagtctagaacgatggagctagacttatttacgtggtttgacgttaggcctaaanaaaccgtacgtaccgtagggtacttccggtttaccggacccggttcggggaaccctaacgggttcctaacccggttccgtaaggtccaaacggccccaaacgggccccaaaccccgtntcgtccttaccttccgttccgtaacccc

SEQ ID NO: 403091 - DNA, 683 bp, Homo sapiens
  misc_feature: GZ8MTXP01B0GBO.13.11.A11.1.454.CMB.2.raw
  modified_base (261)..(261): a, c, t, g, unknown or other
  modified_base (275)..(275): a, c, t, g, unknown or other
  modified_base (438)..(438): a, c, t, g, unknown or other
  modified_base (463)..(463): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgaggagtcccnccccagtctctcgngtgtacgagtacaaactcaagaacgtaacgacgacggtctcggacggtaccgtaccgacgtcctcttctcgtacgacctacgaagtatcgtaaccttacccgaaccgaaacgacgggtaaggtactttaacttactactacgttccgtttcggcggtaccccncgttaacgtcgtacggtaaccggtntagggaccggttctaacgtaaattttaccgtttaagggttgttttacgtaacgtcgaaacaacccgtaaacgccgttaccggtattccgttaccggtaccgtaccgggtaaccggggaccttaccgggtaccacccggttacgttacggacccgacccgaacccggtaaccgaacccccctaacccgttggtaccgttaccctccgtttccgttcccccg

SEQ ID NO: 403092 - DNA, 344 bp, Homo sapiens
  misc_feature: GZ8MTXP01A8XMM.13.11.A11.1.454.CMB.2.raw
  modified_base (244)..(244): a, c, t, g, unknown or other
  modified_base (336)..(344): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagacttttgctacttttatttcngtcaccagtatggaactgtggctgcacatctgtcttcatccttcccgcatctgatagtacgtgactgagcgggctcggcaggcgacataagnnnnnnnnn

SEQ ID NO: 403093 - DNA, 578 bp, Homo sapiens
  misc_feature: GZ8MTXP01EBVB1.13.11.A11.1.454.CMB.2.raw
  modified_base (172)..(172): a, c, t, g, unknown or other
  modified_base (215)..(215): a, c, t, g, unknown or other
  modified_base (324)..(324): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtcgtccgtgtccccaggacagacagccagcatcacctgctntagaaataatgacagataaatatacttctggtatcagcagaagtcaggccagtcccctgtgctggtcatctatcaagatgaccaagccggccctgagggactcccccgngacgcgtattctcgtcggcctaccaactcgtacgggaacctcgacgccctactctacgaccagtccgacggaccgggacccaggcctaagtcggagtaggacggtcgttaggtaaccttagttaccgtggtacgagggtcggtacgggactagggacacgccaacgtcgcccgtattacgtcgttccgttacgggaacgttcgggaaccgtaacggtcctaacccgggttacttaacgtcccgaacgaaccccg

SEQ ID NO: 403094 - DNA, 533 bp, Homo sapiens
  misc_feature: GZ8MTXP01BLTJF.13.11.A11.1.454.CMB.2.raw
  modified_base (512)..(512): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaatcagataaacgacagggctctggacgtccccagccgcttctctggactccaaggatgattcccgaccaacgcagggatattactcatctcgtgggctcagtctgacgatgaggctgacttattactgggtttgaacttggtacacaaacgaaccgcctggattccgtcggacctgggaaccacgggttcaccgttcgacggtcacgccaacggcccaaacccnctcgtcactcgttcgttcccc

SEQ ID NO: 403095 - DNA, 645 bp, Homo sapiens
  misc_feature: GZ8MTXP01AK0TY.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctcccctagtttcctccgtgaggttcaggtacaaactcaagaactaaacgacagggctcgtggacgtccccgagcccgtcttctcgtggactaccgaaggactgacttcccgaccaacgccgaagggtattacttactctactctcgttagggccttccgagttcctaggaaccggtatcgggacggtcttacggtaacttagtttaaccgttgggtttacgtacgtttcggaactaaccgaaaccgacgtccgtaggacttccgttccggaccgttgggaaccctccggttctacccgttccgtaacgggccaccgccccgaaccggaaccccaaccccgtaacgtccgtaccttacccgttcccgttcccgttaaccccccg

SEQ ID NO: 403096 - DNA, 666 bp, Homo sapiens
  misc_feature: GZ8MTXP01E24UG.13.11.A11.1.454.CMB.2.raw
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaaccgacagaacgccaggggactccctcccctagttctcctgaggttcaggtcaaactcaagaactaaacgacgagggctcgtggactccccagccgtcttctcgtggactaccgaaggactcgacttcccgaccgaacgcgagggtattactactctatccgtcgtcgggtcctccgaagttccgtaggtaaccgaagttggaacgggtcttcgttaaacctttacgttacgttacgggttacgtaacgttaccggaaccaaaccgtaaccgtaccggtccggtacggtaccgtccggtaccggtacccggtacgggaacccgtaccggttcccgtacccgttaccgtaaccggtacccgacccgaccccgaacccggtaacccctacccgtaacgtccgtcccgttacccttcccgttcccgtccccg

SEQ ID NO: 403097 - DNA, 570 bp, Homo sapiens
  misc_feature: GZ8MTXP01CNTSS.13.11.A11.1.454.CMB.2.raw
  modified_base (211)..(211): a, c, t, g, unknown or other
  modified_base (285)..(285): a, c, t, g, unknown or other
  modified_base (310)..(310): a, c, t, g, unknown or other
  modified_base (381)..(381): a, c, t, g, unknown or other
  modified_base (384)..(384): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttanacagctccgacaataggaactacttagcttggaccaacagaaaccaggacagcctaccgaagttactctttacnggctctacccgggaatccgggtccngaccattcagtggcagcgggtctgggacagtactttcactctcaccaatcaagcagccttcagctgaaagntgnggctagtttatactgtacagacaatattatatctctacctcgtacggtacgttccgaccgaacgggacctaaggggtaggaaactacgaaaacgtaacgtggtcgcgttacgcctaaccctattcccgttagttccttaaccaagttcccctttaccccggaccttacttaaccgttggttaaacg

SEQ ID NO: 403098 - DNA, 572 bp, Homo sapiens
  misc_feature: GZ8MTXP01A5B6C.13.11.A11.1.454.CMB.2.raw
  modified_base (172)..(172): a, c, t, g, unknown or other
  modified_base (298)..(298): a, c, t, g, unknown or other
  modified_base (499)..(499): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataaattggacagaataaatatacttcctggtatcagcagagtacaggccagtcccctgtgctggtcatctatcaagntgcccaagccggccctcgagggactccccctggagcgtattcgtctcgggcctccaaactcgtggggaacctcgacgcccactctgaccatccgaggccgggacccaggtccgtaagtggacttggacggtccgtaggtaaccttagttacgtggttccgagggccggtaggggactaggcaggccaacgtcgccccggtnttacgtcgttacgttcggacgttcggggaaccctagggtcccaccggtaccttaggtccaacggtaacccccg

SEQ ID NO: 403099 - DNA, 645 bp, Homo sapiens
  misc_feature: GZ8MTXP01EX7KS.13.11.A11.1.454.CMB.2.raw
  modified_base (172)..(172): a, c, t, g, unknown or other
  modified_base (216)..(216): a, c, t, g, unknown or other
  modified_base (241)..(241): a, c, t, g, unknown or other
  modified_base (280)..(280): a, c, t, g, unknown or other
  modified_base (339)..(339): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatccacctgctntaggaaataatggacagaataaatntacttctaggtatcagacagaagtcaggccacgtccccngtcgctggtcatctatacgaagctcgaccaaggccgtacctcgacgggtactcccccgnggacgcgtattcctcgtggccctacctaaacgttccggtaacgggaacctcgaacgtccctactcgtacgaaccagtaccacgggacccggaccctagggccttaaaggtccggagtacgggtacgggacttaaggtaaccctttaagtttaccggtgttacccggagggttcgggacggggaaaccgcgacgacgtcgtaaccgtccgacccgttagttacggttacgtaaccggttacgggacggttaccgggaacccgtacggtaaccgtaaccggtaccgttacgtcccgaacccgaacccg

SEQ ID NO: 403100 - DNA, 395 bp, Homo sapiens
  misc_feature: GZ8MTXP01C7L8W.13.11.A11.1.454.CMB.2.raw
  modified_base (302)..(302): a, c, t, g, unknown or other
  modified_base (390)..(395): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactacttttggccgtaggggaccaagctggagatnaagcgaactgtgctgcacatctgtcttccacttctcccgcactctgctagtacgtgactggacgcgggctggcgaaggcgacagtagnnnnnn

SEQ ID NO: 403101 - DNA, 763 bp, Homo sapiens
  misc_feature: GZ8MTXP01ARPIZ.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcccagtctcacctgcaccttgcgcagtggcacatgttgtcctatgacatatattggtaccacagagccgagggacgtccctcccctagtttcctccgtgtacggttcaggtacaaactcaagaataaaccgacacgggctcgtggacgtccccagccgtcttctcgtaggacctccgaaggatcgtaacgttcccgacccgaacgccgtaaggggaacttaactttacctactaacttcccgttcgttcgggggtacccttcccgtaacgggtttccttagggaacccggtaagttgggaacggtcccgttaggtaacctttaagttttaaccgttggggttttacggtaacgtttcgggacctaaaccaaaccgaaccgtcccgtagggtaacttccgtttaccgggacccgttcggggaaccccgtaaccgggtttcccgaaacccgggttccccgtttaaacggggtccccgaaccgggaaccccccggttaaaccggggtaacccccccgaaaacccccttaaccggttacccgttccccgttaaccgtttccccgtttaacccgggttttaaccccccccc

SEQ ID NO: 403102 - DNA, 580 bp, Homo sapiens
  misc_feature: GZ8MTXP01C3OA5.13.11.A11.1.454.CMB.2.raw
  modified_base (330)..(330): a, c, t, g, unknown or other
  modified_base (345)..(345): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtccctatgacatatattggtaccgacagaagccagggatcctccccagtttctcctgaggttcaggtcaaactcagaataaacgacagggctctggacgtccccagccgcttcnctggactccaaaggntgacttacccgacaacggcaagggatatactcatctctggctccgagtctagacgatgaggtctagtaacttatttaaccgttggtttgaacgtttcggacaacaaacgaaccgccgttaggacttccgttaccggaccttcggggaaccctacgggttcacccgttccgttaaagggcaacgccccaaacggccccaaaacccgtctcgaccttacttccgttcgtttcccccg

SEQ ID NO: 403103 - DNA, 551 bp, Homo sapiens
  misc_feature: GZ8MTXP01B0RQ0.13.11.A11.1.454.CMB.2.raw
  modified_base (258)..(258): a, c, t, g, unknown or other
  modified_base (328)..(328): a, c, t, g, unknown or other
  modified_base (342)..(342): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagcagggatccnccccagttctctgaggttcaggtcaaactcagataaacgacagggctcgtggacgtccccagccgcttcnctggactccaaggntgactcccgccaacgcgagggatatactcatctctgggctcgagtctgacgatcgagctgacttattacgttggtttgacgttggactaacaaaccgaaccgtcctgggacttccggttaccggaccgtcgggaacctacgggttccacccgttcgtacggtcacgcccaacggcccaacccctctcgtccactccttccgttaacccc

SEQ ID NO: 403104 - DNA, 573 bp, Homo sapiens
  misc_feature: GZ8MTXP01EPUMC.13.11.A11.1.454.CMB.2.raw
  modified_base (255)..(255): a, c, t, g, unknown or other
  modified_base (344)..(344): a, c, t, g, unknown or other
  modified_base (396)..(396): a, c, t, g, unknown or other
  modified_base (541)..(541): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccacagagcagggatcccnccccagtttctcctgacggttcaggtcaaactcagataaacgcagggctcgtggacgtccccagccgtcttctctggactccgaaaggntgacttcccgacaacgcagggtatacttactcatctcgtgggctccgagtcngacgatgagctgacttattacttggtttgtacgttggacaacaaccaacgtccgtaggtactcgttaccggaccgtcggggaaccctacgggttcctacccggttccgtacgggtccacggccccgaaacgggccccaaaccccncgttcgaccttaccttccgttccgttcccccc

SEQ ID NO: 403105 - DNA, 529 bp, Homo sapiens
  misc_feature: GZ8MTXP01EX7UI.13.11.A11.1.454.CMB.2.raw
  modified_base (261)..(261): a, c, t, g, unknown or other
  modified_base (333)..(333): a, c, t, g, unknown or other
  modified_base (402)..(402): a, c, t, g, unknown or other
  modified_base (465)..(465): a, c, t, g, unknown or other
  modified_base (498)..(498): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcccnccccagtttctcctgaggttcaggtcaaactcagataaacgacagggctcgtggacgtccccagccgcttcnctggactccaaggatgacttccgaccaacgcaagggattattactcatctctgggctcgagtctgacgntgagctgacttattactggttgtacttggcacaacaacgctggatcgttcggcctgggaaccncggttcaccgttcgtacggtcacgccgaggccncgccccgtcggtcacctccgttcgttccccc

SEQ ID NO: 403106 - DNA, 537 bp, Homo sapiens
  misc_feature: GZ8MTXP01EKEPW.13.11.A11.1.454.CMB.2.raw
  modified_base (512)..(512): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaagccagggagtcctccccagttctcctgaggttcaggtcaaactcagataaacgacagggctcgtggacgtccccagccgcttctctggactccaaggatgacttccgaccaacgcaagggatagttactcatctctgggctcagtctgacgatgagctgactattactggtttgacttggctacaacgaacgcctaggacttcgttacggaccgtgggaaccacgggttccaccgttcgtagggtcacgcccaacggcccaaccccnctcgtcacctccttcgttaaccccc

SEQ ID NO: 403107 - DNA, 620 bp, Homo sapiens
  misc_feature: GZ8MTXP01EU4U6.13.11.A11.1.454.CMB.2.raw
  modified_base (352)..(352): a, c, t, g, unknown or other
  modified_base (423)..(423): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttctcctgaggttcaggtcaaactcagaataaacgacagggctcgtggacgtccccagccgtcttctctggacctccgaaggntgacttacccgccaacggcgaggtatacttactcattctcgtggcctcgtagtcgagacgtagtggacgtntacgtactttagtttacgttgggtttacgtacgttcggaaccaaactaaaccgtacgtccgtagtacgttccggttaccggaccgtcgggaacccgtacggttccgtacccgttacgtacggtaccgaacccggacccgaaaccggaacccccaaccctcgttcgtaccttaccttccgttaaccccgttaaccccc

SEQ ID NO: 403108 - DNA, 527 bp, Homo sapiens
  misc_feature: GZ8MTXP01BHHO6.13.11.A11.1.454.CMB.2.raw
  modified_base (260)..(260): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcccagtctcacctgcaccttgcgcagtggcaccaatgttggtccctatgacatatattggtaccgacagaagcagggagtccnccccagttctcctgagttcaggtcaaactcagataaacgacagggctcgtggacgtccccagccgcttctctggactccaaggatgacttccgaccaacgcaagggatattactcatctctggctcagtctgacgatgacggctgactattactggtttgacgttgcactaacacgctaggatccgttacggcctgggaaccacggttccaccgttcgtacggtcacgcccaacgtcccaccccgctcgtcacctcgttcgtccccg

SEQ ID NO: 403109 - DNA, 671 bp, Homo sapiens
  misc_feature: GZ8MTXP01BPH7T.13.11.A11.1.454.CMB.2.raw
  modified_base (337)..(337): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttcctcctgaggttcaggtacaaactcagaataaacgacagggctcgtggacgtccccagccgcttcnctggacctccgaaggactgacttacccgacctaacggcgagggattacttactcatctcgtgggctccgagtctgacgagtgacggctagtaacttagtttacgttggggttttacgtaacgtttcgggacctaaaccgaaaccgtaaccggtcccgttaggggtaccttccggttacccgggtaaccgttccgggggaaacccgtaccggttacccgtacccggttacccggttaacgggtaccaacccggttaccccgaaaccgggaaccccctaaacccctaaccgttaccggtacccttacccttccctttcccggtttaaccccccccg

SEQ ID NO: 403110 - DNA, 545 bp, Homo sapiens
  misc_feature: GZ8MTXP01EL0OJ.13.11.A11.1.454.CMB.2.raw
  modified_base (233)..(233): a, c, t, g, unknown or other
  modified_base (418)..(418): a, c, t, g, unknown or other
  modified_base (526)..(526): a, c, t, g, unknown or other
tcagtcacgtactacacgaccggtgctcgatttagctacgactgcagggggggtctcaggaggcagcgctctcaggacatctccaccatggcctgggctctgctattcctcaccctcctcactcagggcatagggtcctgggcccagtctgccctgactcagcctgcctcgtgtctgggtctcctggacagtcgatcaccatctcctgcactgggaccagcagtgacgttcgnggtcaagctatgtctcctggtaccaacaacacccaggcaacggcccccaaatcattaattatgatttcactaatcggccctcgaggtgtatctaatcgcttccactggctccaagtctggccaacaccggccctccctagacccatctctgggcctccgaggcagaggacgagctgattattacngcgggctccgtgacgtattacgcttacccttatcgtacgttcgggactggtcgaaccttaagggtccttaaccggtcctagggttccacgcccaaggccccaaacccntcgcctaacgttccgtccg

SEQ ID NO: 403111 - DNA, 564 bp, Homo sapiens
  misc_feature: GZ8MTXP01EGOYJ.13.11.A11.1.454.CMB.2.raw
  modified_base (360)..(360): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaattgttggtccctatgacatatattggtaccgacagaagccgagggacgtccctcccctagttctcctgaggttcaggtacaaactcaagaataaacgacagggctcgtggaccgtccccgagccgtcttctctggacctccgaaaggtntgacttcccgaccaacgcgaagggattagttactacatctcgtgggctcgagtctgacgatggagctagacttattacttggtttgacgttggactaacaacgacgcctaggacttcgttacggacctcgggaacctcggttcaccgttcgtacggtcacgcccgaacggcccaaccctcgtcgccactccgttcgttcccccg

SEQ ID NO: 403112 - DNA, 578 bp, Homo sapiens
  misc_feature: GZ8MTXP01DNGWK.13.11.A11.1.454.CMB.2.raw
  modified_base (379)..(379): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtcgtcgggacccccggcagagtgtcaccatctcttgttctggaggcagtcgccaacagtcgggaagtaattatgctattctggtatacaaactaacctcccgaggaaccggcccccagacctcctcatctatagcaataacccagccggccctcgacgggtccctgaccccgtattctcgtcggctaccaacgtcncggcctacctcacgccctcctcggcccatcaggtcggccgtcccggtccgacgtatcgaggctgtattacgttacgtgttccgagtcgttggatgacagtcctagtattacgttgggtttcgcgggttaggtaccttaggttccgacccgttccgttggttcaacgcccgaaggtcctcgccccctggttcctaacccg

SEQ ID NO: 403113 - DNA, 386 bp, Homo sapiens
  misc_feature: GZ8MTXP01CXG7Q.13.11.A11.1.454.CMB.2.raw
  modified_base (343)..(343): a, c, t, g, unknown or other
  modified_base (377)..(377): a, c, t, g, unknown or other
  modified_base (381)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcacagtatggtagcacgtactctttggccaggggaccaagctaggagatcaaagcgaaactggtcgctgcacatctgtcttccatctcccgcatctagntagtaccgtgactgacgcgggctggcaaggcganatgnnnnnn

SEQ ID NO: 403114 - DNA, 391 bp, Homo sapiens
  misc_feature: GZ8MTXP01A7KHS.13.11.A11.1.454.CMB.2.raw
  modified_base (310)..(310): a, c, t, g, unknown or other
  modified_base (381)..(381): a, c, t, g, unknown or other
  modified_base (386)..(391): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttattctgtcacagtatggtaggtcaccgtactactttggcctaggggaccaagctggagatcaagcgaactggngctgcaccatctgtcttccatccttcccgcctatctcgaatagtacgtgactggagcgggctggcaaggcncatgnnnnnn

SEQ ID NO: 403115 - DNA, 575 bp, Homo sapiens
  misc_feature: GZ8MTXP01C8EXS.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcaagataaacgacagggctctggacgtccccagccgcttctctggactccgaaaggatgacttcccgaccaacgcaacggggattacttactcaactctctgggctccgagtcctagacgatgaggctgacttatttacgtggtttcgactttggccaacaaacgaacgtcccgttaggaacttcgtttaccggaccgttcggggaaccctaacgggttccaacccgttcgtacggtcacggcccaaacggcccaaccccaatcgtacacctcttcgttaacccc

SEQ ID NO: 403116 - DNA, 535 bp, Homo sapiens
  misc_feature: GZ8MTXP01CPPHN.13.11.A11.1.454.CMB.2.raw
  modified_base (259)..(259): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagtttctcctgaggttcaggtcaaactcagataaacgacagggctctggacgtccccagccgcttctctggactccaaggatgattacccgcaacgcagggatatactcatctcgtggctccagtctgacgatgaggctgactattactggtttgacttggcacgaacaaccgctaggatcgtcggacctgggaaccacggttcaacccgttctacgggtcacgcccgacggaacccaaccccaactcgtccacctccttcgtttaaccccc

SEQ ID NO: 403117 - DNA, 338 bp, Homo sapiens
  misc_feature: GZ8MTXP01C2C7Q.13.11.A11.1.454.CMB.2.raw
  modified_base (336)..(338): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaaacctgaagtctttgctacttttattctgtcaccagtatggaactgtggctgcaccatctgtcttcatccttcccgccatctgatagtacgtgactgagcgggctcggcaaggcgcatagnnn

SEQ ID NO: 403118 - DNA, 559 bp, Homo sapiens
  misc_feature: GZ8MTXP01AYJC0.13.11.A11.1.454.CMB.2.raw
  modified_base (252)..(252): a, c, t, g, unknown or other
  modified_base (327)..(327): a, c, t, g, unknown or other
  modified_base (333)..(333): a, c, t, g, unknown or other
  modified_base (337)..(337): a, c, t, g, unknown or other
  modified_base (358)..(358): a, c, t, g, unknown or other
  modified_base (427)..(427): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccggcagagtgtcaccatctcttgtctggaggcagtgccaacagtcgggagtaattangcattctggtatcaacaactcccgaggaaccgccccagctctcatcatagcaataaccagcgcctcgagggtccngaccgnttcnctgctacaagtctgcacctcngccctcctgccatcagtcggctccggtccgacgagtcgagctgtattaattcgtagttcagtcgttggntgacacgtccgtagtaacgttacgttgggttttcgggacgggttacgggtaaccgttaggttacggacccggttacccgttcggttaccgaacgcccgaacggtccgtccggccccgttccggttcctcccg

SEQ ID NO: 403119 - DNA, 387 bp, Homo sapiens
  misc_feature: GZ8MTXP01C53KV.13.11.A11.1.454.CMB.2.raw
  modified_base (244)..(244): a, c, t, g, unknown or other
  modified_base (347)..(347): a, c, t, g, unknown or other
  modified_base (356)..(356): a, c, t, g, unknown or other
  modified_base (383)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaaagactttgctactttatttcngtcaccagtatggtaggtcaccgtacacttttggccaggggaccaagctggagatcaagcgaactgtggctgcaccatctgtcttccatcttcccgcatctgntagtacgtnactgagcgggctggcaaggcgcatagnnnnn

SEQ ID NO: 403120 - DNA, 381 bp, Homo sapiens
  misc_feature: GZ8MTXP01D14UP.13.11.A11.1.454.CMB.2.raw
  modified_base (344)..(344): a, c, t, g, unknown or other
  modified_base (374)..(374): a, c, t, g, unknown or other
  modified_base (379)..(381): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtactttgcttacttttattctgtcaccagtatggtaggtcaccgtactactttggccaggggaccaagctggagatcaagcgaactgtggctgcacatctgtctcatctcccgcatctgntagtacgtgactgagcgggctggcaggcgnatagnnn

SEQ ID NO: 403121 - DNA, 514 bp, Homo sapiens
  misc_feature: GZ8MTXP01BL8AV.13.11.A11.1.454.CMB.2.raw
  modified_base (349)..(349): a, c, t, g, unknown or other
  modified_base (451)..(451): a, c, t, g, unknown or other
  modified_base (463)..(463): a, c, t, g, unknown or other
tcagtcacgtactacacgaccggtgctcgatttagctacgactgcagggctgggcctcaggaggcagcatcggaggtgcctcagccatggcatggatccctctcttcctcggcgtccttgcttactgcacagaatccatggcctcctatgagttgactcagccaccctccatgtccgtgtccccggacagacagcctacatcacctgctctggagatgtattgactaacgagtatggtcctggtatcagcagaggcaggccagccccctgtcctactcatctttacaaaatacaggcgcctcgtgggggtccctggagcgattcctccccggctcgcctctggaacacngtcactctgaccatcacgcgggacccagcctattgatgaggctgtctacttctgtccagggggcgtgggacaacgagcgtgcgtggtcggcgggacggccgngtcgtgaccgtnttagggtcagttcccgaggctcgccccgtgtcacttctccgttcccgtccc

SEQ ID NO: 403122 - DNA, 531 bp, Homo sapiens
  misc_feature: GZ8MTXP01DFQ5Y.13.11.A11.1.454.CMB.2.raw
  modified_base (491)..(491): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaaccgacagaagccagggagtccctccccagtttctcctgaggttcaggtcaaactcagataaacgacagggctctggacgtccccagccgcttctctcggatcaaggatgaacttccgccaaacgcagggatatactcatctctgggctcagtctgacgatgaggctgacttattacgtgttttgacttggctaacaacaacgtcctggtactcgttcggaccgtgggaccacggtcaccgtcgtaggttcncgacccaaggacccaacccgctcgttctaacttcgtcccg

SEQ ID NO: 403123 - DNA, 715 bp, Homo sapiens
  misc_feature: GZ8MTXP01CTG48.13.11.A11.1.454.CMB.2.raw
  modified_base (172)..(172): a, c, t, g, unknown or other
  modified_base (236)..(236): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctctaggaaataatggacagataatntactctgtatcagcagagtcaggccacgtcccctgtgctggtcatctaatcaagatcgaccaaggccggccctagacgggtctccccccgtggacgtcgtaacttcccgtacgtcgggccttacccgtaaacgtccggttacggggaaacctccgacgacccctaacttcgtacggaaccctacgtaccgaacgggacccggggaacccctaagggtaccgtaaggttacgggaagttacggggaaccggggtacttacgggtaaaccttttaacgtttaccggttaggttacccggggaacggggttacgggttaccgggggaaactacgggtacccgaaggtccgaaccgtccgggccccgttacgttcgttaacgggtttccgttaaccggggaaccggttaccggggaaccccgtaaacggggtcccctaacccgggttaccgttaacgttaaccccgaaccggtaaacccccgg

SEQ ID NO: 403124 - DNA, 720 bp, Homo sapiens
  misc_feature: GZ8MTXP01D5MCV.13.11.A11.1.454.CMB.2.raw
  modified_base (188)..(188): a, c, t, g, unknown or other
  modified_base (214)..(214): a, c, t, g, unknown or other
  modified_base (228)..(228): a, c, t, g, unknown or other
  modified_base (516)..(516): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctctatgagttgactcagccaccctcatgtccgtcgtccccgganagacagcctacatcactgctctgganatgtatgactaagngtatgtctgtatcagcagagcaggccacgcccctgtcctactcattcctttacaaaactaccgaggccggtccctcggtcgggtccctgacgcgtacttccgtccccggcctccgccctcgtacggggaaaacccacgtcgttaccaaccgttccctacggaaccctagtaccgaacgggcccgggaaccctaggtacccgtagttcgaagttcggacggtccttcgttaccgttacgttcgtacggtcggtaacgggggtcgggttaaccggggaaactaaaccggngggttccgttcgggttccgttacggggtttcccggggacggggtaaccggggtacccgtgggttccgttaccgggttacccgggtttacgttaacggggtaccctaacccgggaccccgttaacgggccccgttcccggtccccccggttaacgggttcccctacccgtttcccggttccccgggtttccccccgttcccccgg

SEQ ID NO: 403125 - DNA, 515 bp, Homo sapiens
  misc_feature: GZ8MTXP01DI8K3.13.11.A11.1.454.CMB.2.raw
  modified_base (256)..(256): a, c, t, g, unknown or other
  modified_base (459)..(459): a, c, t, g, unknown or other
  modified_base (496)..(496): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccacagaagccagggatccnccccagttctcctgaggttcaggtcaaactcagataaacgacagggctctggacgtccccagccgcttctctcggactccaaaggatgaattcccgaccaacgcaagggatatactcactctcgtggctccagtctgacgatgaggctgactattactggtttgacttgacacaacacgcctggatcgttcgacctggaaccncgttcaccgttcgtaggtcacgcccaagcccaacccnctcgcactcgttcgtcccc

SEQ ID NO: 403126 - DNA, 530 bp, Homo sapiens
  misc_feature: GZ8MTXP01EPUL8.13.11.A11.1.454.CMB.2.raw
  modified_base (172)..(172): a, c, t, g, unknown or other
  modified_base (238)..(238): a, c, t, g, unknown or other
  modified_base (442)..(442): a, c, t, g, unknown or other
  modified_base (459)..(459): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggacagataaatntacttctggtatcagcagaagtcaggccagtcccctgtgctggtcatctatcaagatcgccaagcgccctgagggactcccccctgagcgtattcctctggcctccaaactcgtagggaactcgacgccctactctcgaccatcaggccgggacccaggctagtgatagaggcgtagacttattacgtgtcgaggcgtaggacngcagcaacgtgccccgnttagtcgtcgttacggacgttcggggaaccctaaggtcctaccggtacgttaacgtccgaacgtaaccccg

SEQ ID NO: 403127 - DNA, 390 bp, Homo sapiens
  misc_feature: GZ8MTXP01A1SYB.13.11.A11.1.454.CMB.2.raw
  modified_base (345)..(345): a, c, t, g, unknown or other
  modified_base (382)..(390): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttatttctgtcaccagtatggtagtcaccgtactactttggccaggggaccaagctggagatcaagcgaactgtggctgcaccatctgtcttcatcttcccgctatctgntagtacgtgactgagcgggctggcgaaggcgcatagnnnnnnnnn

SEQ ID NO: 403128 - DNA, 392 bp, Homo sapiens
  misc_feature: GZ8MTXP01D3BKX.13.11.A11.1.454.CMB.2.raw
  modified_base (386)..(392): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggcctaggggaccaagctggagatcaagcgaactgtggctgcacatctgtcttcattcttcccgcctatcctgaactagtacgtgactgagtcgggctggacaaggcgcatagnnnnnnn

SEQ ID NO: 403129 - DNA, 567 bp, Homo sapiens
  misc_feature: GZ8MTXP01CW3ZO.13.11.A11.1.454.CMB.2.raw
  modified_base (255)..(255): a, c, t, g, unknown or other
  modified_base (264)..(264): a, c, t, g, unknown or other
  modified_base (344)..(344): a, c, t, g, unknown or other
  modified_base (514)..(514): a, c, t, g, unknown or other
  modified_base (541)..(541): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtacacagaagcaggatccncccagttcncctgagttcaggtcaactcagaataaacgacgagggctcgtaggacgtccccagtccgcttctctggacctaccgaagtntagacttacccgaccaacgcaagggatatactcatctcgtggctcagtctgacgatgaggctgactattacttggggtttcgtacttcggactaacaaacgaacgccgtaggacttccgttaccggaaccgttgggaaccctacggttcctaacccgttcgtaacggtcncgttacccgacgaacccctaaaccccncgtctaccaccttccgttccgtcccc

SEQ ID NO: 403130 - DNA, 516 bp, Homo sapiens
  misc_feature: GZ8MTXP01CMDJN.13.11.A11.1.454.CMB.2.raw
  modified_base (367)..(367): a, c, t, g, unknown or other
  modified_base (499)..(499): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgcctatgacatatattggtaccgacagaagccagggatccctccccagtttctcctgaggttcaggtcaaactcagataaacgcagggctcgtggacgtccccagccgcttctctggactccaaggatgattcccgcaacgcaagggatatacncatctctgggctccagtctggcgatgaggctgactattacttgggtttgacttggaccacaacaacgccttaggactcgttcggactgggaaccacggttcaccgttctaggtcacggccaaggcccaaccntcgcactcttcgtcccc

SEQ ID NO: 403131 - DNA, 537 bp, Homo sapiens
  misc_feature: GZ8MTXP01C1JMU.13.11.A11.1.454.CMB.2.raw
  modified_base (343)..(343): a, c, t, g, unknown or other
  modified_base (368)..(368): a, c, t, g, unknown or other
  modified_base (512)..(512): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaagntgattccgcaacgcagggatatacncatctctgggctccagtctgacgatgaggctgacttattactgggttttgactttggctacaacaacgcctagggactcttcggacctgggaacctcggttcaccgttccgtagggtcaacggcccaaagggccctaaaccccnctcgtccacctcttcgttaaccccc

SEQ ID NO: 403132 - DNA, 335 bp, Homo sapiens
  misc_feature: GZ8MTXP01EUIE2.13.11.A11.1.454.CMB.2.raw
  modified_base (277)..(277): a, c, t, g, unknown or other
  modified_base (325)..(325): a, c, t, g, unknown or other
  modified_base (331)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtggctgcacatctgtctnatcttcccgcatctgatacgtacgtgactgagcgggctggcaaggcgnataagnnnnn

SEQ ID NO: 403133 - DNA, 644 bp, Homo sapiens
  misc_feature: GZ8MTXP01DXQ1L.13.11.A11.1.454.CMB.2.raw
  modified_base (200)..(200): a, c, t, g, unknown or other
  modified_base (237)..(237): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcacgccaccctcagcgtcgtcgggaccccggnagagtgtcaccatctcttgtctggagcagtgaccaanagtcgggaagtaattatgctattctagtatacaaacaacctcccgaaggaccggccccagacctctcgatctaatacgacaaactaaccgagccgcctacgacggggtccctagacccgtattctgtcgctaaccgaatcgtcgccaccctcgacgtccctccgtcgacctagtcgacgggtcgggtcccgtccgggtacccgagagtcggacggtctagtaactttacgttacgttcgttacgacgtcgttaggacttgacgtaacgtccgttaggtaaacgtttcgggtttgggggttaacgacggggacgggtaacccttaagggtcccgtaccggttacccgttcggttacgaaccggcccgtaaggtcccgtacccgttccccggttcggttccctttcccg

SEQ ID NO: 403134 - DNA, 783 bp, Homo sapiens
  misc_feature: GZ8MTXP01BP14Q.13.11.A11.1.454.CMB.2.raw
  modified_base (268)..(268): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgttgactcagccgtcttccctctctgcttctcctggagcgtcagccagtctcacctgcaccttgcgcagtggcaccaatgttggtcctatgacatatattggtaccgacagagccagggagtcctcccagtttcncctgagttcaggtcaaactcagataaacgacgagggctcgtgggacgtccccagcccgtctttctctggactaccccgaaaggatcgaactttcccgaacccaaacggccgaaggggtaacttaatttacctcaacgttcttcgtcgggggtccttacccgtaagtcgttaggaaccgtaagtgggaacgggtccttaggtaacctttaaattttaaccgtttgggtttttacggtaaccgttttagggggaacccctaaaccgaaaaccctaaacccggtccccgtttaggggtaaaccttttcccggtttaacccgggggtaaccccggtttacggggggaacccccgtaaccgggggttaccccttaaaccccggggtttccccgttaaacggggttacccgaaacccgggttaccccccggaaaaccggggaccccccaaaacccccccggtactcccggttaccccgtaaccctttcccttaaccccgggtttccccccctaaccccccg

SEQ ID NO: 403135 - DNA, 383 bp, Homo sapiens
  misc_feature: GZ8MTXP01DURP1.13.11.A11.1.454.CMB.2.raw
  modified_base (379)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggagcctgaagtattttgctagtttattactgtcaccagtatggcacctcaccgctcactttcggcggaggaccaaggtgagatacaaacgactgtggctgcacatctgtcctcatctcccgcaatctgatagtacgtgactgagtcgggctggcaaggcgcatagnnnnn

SEQ ID NO: 403136 - DNA, 691 bp, Homo sapiens
  misc_feature: GZ8MTXP01DC7AB.13.11.A11.1.454.CMB.2.raw
  modified_base (367)..(367): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaacgccgagggactccctccccagtttcctccgtggacggttcaggtacaaactcaagaactaaacgacgagggctcgtaggaccgtccccgagccgtcttctcgtaggacctaccgaaaggtntacgacttacccgaccaacggcgaaaggggtacttaacttacctactatccgtcgtgggccttaccgaggttcctaggaacgtagttggaaggtccttagtaacttatttacgttgggttttacgacgtttggacctaaacaaaccgacgtccgtaggtactttccgttaccgggacccgttcgggggaaccctaccggggttcctaaacccggttccgttaaacggggtccaaacccgggcccccgaaaaccggggtaaccccccaaaacccccggtcttccggtacccttaacccgtttcccgttcccgtttaacccccccc

SEQ ID NO: 403137 - DNA, 532 bp, Homo sapiens
  misc_feature: GZ8MTXP01DGD6Y.13.11.A11.1.454.CMB.2.raw
  modified_base (490)..(490): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctcgtggacgtccccagcccgcttctctcggatccaaggatgaacttccgccaaacgcagggatatactcatctctgggctccagtctgacatgagctgactattacttgttgacttggctaacaacaacgcctggtactcgttcggacctgggacccacggtccaccgtccgtaggttccncgaccccaaggcccaacccgactcgttacaacttcgttcccg

SEQ ID NO: 403138 - DNA, 597 bp, Homo sapiens
  misc_feature: GZ8MTXP01BFUPH.13.11.A11.1.454.CMB.2.raw
  modified_base (257)..(257): a, c, t, g, unknown or other
  modified_base (406)..(406): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagcagggatccnccccagttctcctgaggttcaggtcaactcagaataaacgacagggctcgtggacgtccccagccgtcttctctggacctaccaaggatgacttcccgacaacgcgaagggtactattacactatcctgtggctaccgagtctagacgngtgaggctagacttagtttacgttggggtttacgacgtttcggacctaaacaaacgaaccgtccgttaggaactttccggttacggacccgttggggaaccctacgggttcacccggttaccgttagggtccacgttaccccgaacggaaccccaacccctaagtccgtccaccttccttcccgttccccc

SEQ ID NO: 403139 - DNA, 860 bp, Homo sapiens
  misc_feature: GZ8MTXP01A1NL5.13.11.A11.1.454.CMB.2.raw
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagaccacgccacactccactcgtcttcgtaggaatagttagttagtacgtaacgtaacggtagttaggttccggttccgtaggttactacgacgacgaagggacggacggaccggaccgaccccgtcccctcgtaccctactactactttacttaaacaaaccgtaccgacggcccgtccgttcgggtccggtccaggcgacgttcgtccgtccccgtcccgtccgtccgtacggaacggaaaccacgtcgtacctaccttcgaccgacctacgaccgacggggacccccggtaaccacgttccgttagacgggtaagtcggggaaccgtttcgtttaccgttacccgtttaccgttcgggttaccggtaacggggtccggggggggttacccggggttaaaccggggaaaaccccaacccggggttggttcccgggtttaccgggtcccggggttttttaaacccggggggcccggggggtaaacgggggtaaccccgggtaaacccgtttgggttccccggttaaccggggtttacccggtttacggttaccggaaaccccgggacccgttaaaccccgggttcgggttcccccgtcccccccggtccccggttaacggtacccttccccgggtttcccgttccccccgggttcccccctttccccg

SEQ ID NO: 403140 - DNA, 777 bp, Homo sapiens
  misc_feature: GZ8MTXP01DLT40.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccgacagaagccagggacgtccctccccagtttcctcctggaggttcaggtacaaactcagaataaacgacagggctcgtggacgtccccgagcccgtctttcctcgtcggacctacccgaaagggtatacgactttaccccggaccaacggcgaaacggggtacttaactttaccgtactaacgttcccgttaccgtcgggggtccttccggaaggttccttagggaaccgtaagttggaacgggtctagtaacttaactttaaccgtttggggttttacggtaccgtttacggggaccctaaactaaacccgtaaaccgtcccggttacggtaccgtttaccgttacccggggtaaccgtacgggggtaaccccgtaacccggggttcccgtaaaccccggttcccggttaaacgggttcccgaaacccgggccccccgttaaaaacggggcccccccctaaaaaaccccccgtccggtttacccggtaccccgttaaacccgttttcccctttcccgggttttaacccccccccc

SEQ ID NO: 403141 - DNA, 710 bp, Homo sapiens
  misc_feature: GZ8MTXP01CMVTU.13.11.A11.1.454.CMB.2.raw
  modified_base (220)..(220): a, c, t, g, unknown or other
  modified_base (223)..(223): a, c, t, g, unknown or other
  modified_base (237)..(237): a, c, t, g, unknown or other
  modified_base (254)..(254): a, c, t, g, unknown or other
  modified_base (686)..(686): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgccaccttgcgcagtgcacatgttcgcctanganatatagtcgaccanagacgcgaggactcccncctagttctcgtagtagtacgacgtacaaactcgaagaactaaacgacgaacgggtctacggtacggtacccgttacccccgacggtcccgttcctttcgtacgtacgggtacccttacccggaaaggggtactacggtaacccgtttaccccggaaacccgtaaccggacggtaaacggggttaaactttaaacgtttaacccgacttaaacgttccgttaccgggtcggggtaccctacccggtagttaccgtaggaaccggttagtacggtaacggtcgtacgtaacttacgtttacgtttgggttacgtacgttcggaacaaaccgtaacgaccgtcgtaggtcttccgttacggaccgtcgggtaaccctacgggttccctaaccggttcgttaacggcaccgggcccaaccggccccaaaccgtcncgtacttcgttccgttcgttcccc

SEQ ID NO: 403142 - DNA, 390 bp, Homo sapiens
  misc_feature: GZ8MTXP01A13RJ.13.11.A11.1.454.CMB.2.raw
  modified_base (341)..(341): a, c, t, g, unknown or other
  modified_base (379)..(390): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagctttgctactttattctgtcaccagtatggtaggtcaccgtactactttggccgaggggaccaagcgtggagatcaagcgaactgtggctgcacatctgtctcatcttcccgcatctgntagtacgtgactggagcgggctggcaaggcgacatagnnnnnnnnnnnn

SEQ ID NO: 403143 - DNA, 630 bp, Homo sapiens
  misc_feature: GZ8MTXP01AN5WC.13.11.A11.1.454.CMB.2.raw
  modified_base (194)..(194): a, c, t, g, unknown or other
  modified_base (223)..(223): a, c, t, g, unknown or other
  modified_base (340)..(340): a, c, t, g, unknown or other
  modified_base (391)..(391): a, c, t, g, unknown or other
  modified_base (485)..(485): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacagaatccatggcctcctatgagttgactcagccaccctccatcgtccgtcgtcccccgganagacagcctacatccacctgctcgtgganatgtattgaactaacgagtatggttcctggtatcagcagaaggcacggccacgccccctgtcctactcacttctttaacaaaactaccgacggccggtccctcggtcgggggtcccngacgcgtacttcccgtcccggcctccgccttccgtacgggaaaaccaccgngtccaacgtctacggaccatcgacggccggaccaggcctagttgagtgagtctcgtcttacttcgtcgtcgacgggggtcggtaggacaaccgngtcgtgtcgtcggtcgggcggggacgtccgtggtcgtacggttccggtacgttagggtccgaaccggttcccgacgggttcccgtcccggttccccccgttcgggtaccctcccgttccgtttccccgttccccgttaacccccg

SEQ ID NO: 403144 - DNA, 388 bp, Homo sapiens
  misc_feature: GZ8MTXP01A6GUP.13.11.A11.1.454.CMB.2.raw
  modified_base (346)..(346): a, c, t, g, unknown or other
  modified_base (383)..(388): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctggggacagacttcactctcaccatcagcagactggaacctgaaagtctttgctactttattctgtcaccagtatggtagtcaccgtactactttggtccagggaccaagctggagatcaagcgaactgtggctgcacatctgtcttccatcttcccgccatctgntagtacgtgactgacgcgggctggcaaggcgcatagnnnnnn

SEQ ID NO: 403145 - DNA, 675 bp, Homo sapiens
  misc_feature: GZ8MTXP01EQIOF.13.11.A11.1.454.CMB.2.raw
  modified_base (302)..(302): a, c, t, g, unknown or other
  modified_base (375)..(375): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtgtggtacggccgtgggggtccctcagactctcctgtgcaacctctggattcagatttgatgagtatggcatacactgggtcccnccaacctccgagggagggctgcagtgggtctcgtaggtaataaacgtggaatgggtgaccagcaaacaacttntcgcagactcgtggtacgaacgggccctattccacctatcctacgaaagacgtaccaggtcgacccggaaactaaaccttcccggtaaacactttacgtacggaacctaaaaagttccggaaaactacggtttacccgacggggtaaggttacccgggaacggggaaaccctaaccggggttcccttttaggtttaacgtttttccgtgggttaacggccggggttaaggggtttaacgccgtaaggggtttcgggtccgtttacggggttaacctttaaccgggaaccgttaaaagggg

SEQ ID NO: 403146 - DNA, 598 bp, Homo sapiens
  misc_feature: GZ8MTXP01DGR9W.13.11.A11.1.454.CMB.2.raw
  modified_base (201)..(201): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgnagtgcaccaatgttgtcctatgacatatattggtaccgacagaagccagggagtccctccccagtttcctcctgaggttcaggtcaaactcagaataaacgacaggctctgggactcccagccgtcttctctcggatcgaaggatcgaacttcccgccaacgcgaagggtatacttactcatctcgtggctcgagtcagacgatgagctagacttattacgttgtttagacgtttggacctaacgaacgacgtccgtaggtacttaccggttccggaaccgttcggggaaccccttacgggttcccgaacccgttccgtaacgggttaccgaccggaccccgaaaccgggaccccaaaccccgtacgtcggttacctaacccttcgtttaacccccg

SEQ ID NO: 403147 - DNA, 516 bp, Homo sapiens
  misc_feature: GZ8MTXP01ANX9E.13.11.A11.1.454.CMB.2.raw
  modified_base (259)..(259): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagttctcctgaggttcaggtcaaactcagataaacgacagggctctggagtccccagtcgcttctctggactccaaggatgattccgccaacgcagggatattactcatctctgggctcagtctgacgatgaggctgactattactggtttgacttggcacacaacgcctggatctcggacctgggaaccacgggttcacccgttctagggtcagcccaaggcccaacccaactcgtcactcttcgttccccc

SEQ ID NO: 403148 - DNA, 753 bp, Homo sapiens
  misc_feature: GZ8MTXP01CPN2D.13.11.A11.1.454.CMB.2.raw
  modified_base (201)..(201): a, c, t, g, unknown or other
  modified_base (263)..(263): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcacgccaccctcagcgtcgtcgggacccccggnagagtgtcaccatctcttgtctggagcagtgaccaacagtcggggataattatgctattcgnggtatcaacaactcccgaacggaaccggccccagacctcctacatctatagacaaactaaccgagccggcctcgacggggtccctgaccccgtacttctcgtcggtcctaaccgtaaagttccgtacgggaccctaacccgttccgaccggtcccccttcccccgtcggggaccctaacgtaccggtaacggggttccggggtccccgttacccggggtacccggaaccggtaagttcggggacggtaccttacggtaagttttaactttacggttcggttttacgaacggttcgtttacgggggtaattcggaaaccgtacggttacccgttaaggttaaacgtttaccgggttttgggggttttaacccggggacgggttaaacgggggtaacccttaaggtttacccggaaccccgttcccggttaggttacccgaacggtaccccgaacggtcccgtccgttcccccgttcggttccttaaccccg

SEQ ID NO: 403149 - DNA, 614 bp, Homo sapiens
  misc_feature: GZ8MTXP01AONSZ.13.11.A11.1.454.CMB.2.raw
  modified_base (189)..(189): a, c, t, g, unknown or other
  modified_base (216)..(216): a, c, t, g, unknown or other
  modified_base (384)..(384): a, c, t, g, unknown or other
  modified_base (475)..(475): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctgganatgtattgactaacgagtatggttcctggtatcagcagaaggcaggccacgccccctgtccctactcatctttacaaaactccgaggccggccctcgtcgggggtccctgacgtcgtacttccgtcccccggctccggcctcgtagggaaaccacgaagtccacttcncgaccatccgacggccgggacccagtcctattcgataggacggtctacgttctacttcgtcgttccgagggggtcggtaggggactaacgngtccgtggcgttggtccgggcgggtacggccctaggtcgtcggttacccggtgttacgggtccgacggccccgaacggggccctcccggtccccccgttcgggtccctaccggttccttccccgtttcccccgtccccg

SEQ ID NO: 403150 - DNA, 571 bp, Homo sapiens
  misc_feature: GZ8MTXP01AMSVA.13.11.A11.1.454.CMB.2.raw
  modified_base (256)..(256): a, c, t, g, unknown or other
  modified_base (348)..(348): a, c, t, g, unknown or other
  modified_base (377)..(377): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggccctatgacatatattggaccgacagagcagggactccnccccagttctcctgaggttcaggtacaactcagaataaacgacgagggctcgtggacgtccccgagcccgtcttctcgtggactccgaaggntgacttcccgacaacgcgagggatatacncatctcgtggactcagtctagacgagtgaggctagacttattacgtggtttacgacttcggactaacgaacaaccgtcgtacggtacttcgttaccggaccgtcgggaaccctcgggttccacccgttcgtacggtaccaccgacccgaacggccccaaacccgcttcgccttacctccgttccgttaaccccc

SEQ ID NO: 403151 - DNA, 552 bp, Homo sapiens
  misc_feature: GZ8MTXP01A3A8A.13.11.A11.1.454.CMB.2.raw
  modified_base (528)..(528): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggacgtccctccccagtttctcctgaggttcaggtcaaactcagaataaacgacagggctcgtggacgtccccagccgtcttctcgtggactccgaaaggatgacttacccgccaacggcaagggatattactcatctcgtgggctccgagtctgacgatgaggctgacttattactggtttcgacttggacaacaacaacgccgtaggacttccgttcggaccgtgggaaccctacggttcaccgttcgtacggtcacgcccaacggcccaacccnctcgtccactcttccgtaaccccc

SEQ ID NO: 403152 - DNA, 339 bp, Homo sapiens
  misc_feature: GZ8MTXP01D1DDX.13.11.A11.1.454.CMB.2.raw
  modified_base (335)..(339): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcacagtatggaactgtggctgcaccatctgtcttcattccttccgcctatctgatagtacgtgactgagcgggctcggacaggcgcatagnnnnn

SEQ ID NO: 403153 - DNA, 694 bp, Homo sapiens
  misc_feature: GZ8MTXP01DID48.13.11.A11.1.454.CMB.2.raw
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatccacctgctctggagatgtatgactaacgagtatggttcctggtatcagcagaggcaggccacgccccctgtcctactcatctttacaaaactccaggccgccctcgtcgggggtccctggacgcgtagttcctcccccggcctccgccctcgtcggggaaaacccacgtcggtcctaacctccgtacgaacccctagtaccgacgggacccgggaccccacggtcccgttaatttggactagggtacgggtccttcggtccgttacttcgtacggttcgagggggtccgggtacggggaaccaacggacggtcggttcggtccgttgggttccggggacggggtacgggacccgtaagggttcccgtacggacccgggttacgttacgggaccgtaccgggaccccgttaaacgggttccccgtcccgggtcccccccgttcgggtcccctacccgttccccgttccggtttcccccccttaacccccg

SEQ ID NO: 403154 - DNA, 617 bp, Homo sapiens
  misc_feature: GZ8MTXP01AH7RC.13.11.A11.1.454.CMB.2.raw
  modified_base (416)..(416): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggagtccctccccagtttctcctgaggttcaggtcaactcagataaacgacaggctctggacgtccccagccgcttctcgtggacctccgaaaggtatcggtacttacccgaccctaacgcgaaggggattacttactcattctcgtgggctcagtctgacgntgaggctagacttattacgttggtttgacgtttggacctaacgaaccgaaccgtcccgtaggtaacttccgttacccgggaccgttcggggaacccctacgggttcctacccggttccgtaacggggtccaaccggaccccgaaacgggaaccccaaacccccaagttccgtcccgttacttccgttcccgtttccccccg

SEQ ID NO: 403155 - DNA, 585 bp, Homo sapiens
  misc_feature: GZ8MTXP01C7WL2.13.11.A11.1.454.CMB.2.raw
  modified_base (237)..(237): a, c, t, g, unknown or other
  modified_base (252)..(252): a, c, t, g, unknown or other
  modified_base (561)..(561): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttgcctatgacatatattggtaccanagagcgaggactccnccctagttctcctgacggttcaggtacaaactcaagaactaaacgacgaggctcgtggacgtccccagccgtcttctcgtggacctaccgaaaggtatcgacttacccgacaacgcgaagggtatacttactcatctcgtggcctccgagtcctagacgtagtggaggtctagtaacttagtttacgttggggtttacgacgtttggacctaaacgaaacgaccgtccgttaggtactccggttaccggaccgtggggaaccctacggttctaccgttcgtacggtcacgcccgaacgcccaacccgtntcgaccttcgtccttccgtccccg

SEQ ID NO: 403156 - DNA, 515 bp, Homo sapiens
  misc_feature: GZ8MTXP01DBOYW.13.11.A11.1.454.CMB.2.raw
  modified_base (342)..(342): a, c, t, g, unknown or other
  modified_base (372)..(372): a, c, t, g, unknown or other
  modified_base (389)..(389): a, c, t, g, unknown or other
  modified_base (395)..(395): a, c, t, g, unknown or other
  modified_base (437)..(437): a, c, t, g, unknown or other
  modified_base (456)..(456): a, c, t, g, unknown or other
  modified_base (496)..(496): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccacagaagccagggagtcctccccagtttctcctgaggttcaggtcaaactcagataaacgacagggctctggagtccccagccgcttctctggactccaaggntgattccgcaacgcagggatatactcatcnctggctcagtctgacgntgagcngactattactggtttgactttggacaacaacaacgcctaggntcgttcgacctgggaaccncggttcaccgttcgtaggtcacgcccaaggcccaaacccnctcgtcactcttcgtcccc

SEQ ID NO: 403157 - DNA, 622 bp, Homo sapiens
  misc_feature: GZ8MTXP01EPWYH.13.11.A11.1.454.CMB.2.raw
  modified_base (172)..(172): a, c, t, g, unknown or other
  modified_base (213)..(213): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctngaaataatgcagataatatactctgtatcagcagagtcaggccagtcccctgtgctgtcatctatcaagatcgaccaagcggccctcgacgggactccccccgtggacgcgtactttccgtccttgggccttacccaaacttccggtaggggtaaacccttcgaacgtcccctaacttccgtacggaaccccataccgaacggtacccggggaacccctaaggggtcctaaacgttgggaacttagggaacgggtccttaaggtaacctttaagttaaccgtggttacccgagggtacggtaggggactaggcaaggccaacgtcgcccgtcttacgttcggtacgtttacggaacggttcgggaacctaaggtcctaacccgtcgttaacggtcccaacggaaccccg

SEQ ID NO: 403158 - DNA, 565 bp, Homo sapiens
  misc_feature: GZ8MTXP01DO144.13.11.A11.1.454.CMB.2.raw
  modified_base (179)..(179): a, c, t, g, unknown or other
  modified_base (201)..(201): a, c, t, g, unknown or other
  modified_base (264)..(264): a, c, t, g, unknown or other
  modified_base (308)..(308): a, c, t, g, unknown or other
  modified_base (338)..(338): a, c, t, g, unknown or other
  modified_base (351)..(351): a, c, t, g, unknown or other
  modified_base (455)..(455): a, c, t, g, unknown or other
  modified_base (488)..(488): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctnagcgtcgtcgggacccccgggnagagtgtcaccatctcttgttctggaggcagtgccaacagtcgggaagtaattatgctattcnggtatcaacaactcccaggaccgccccagactcctcatctatancaaataccgagccgcctcgacggggtcccngaccccgatttcncgtggcctaccaagtcgtgccaacctcacgccctccgtgcctatcgagtcgggcctcggtccgacgatgaggctgtatttacttacgttcgttcagtcgtgggntgacgagtcctagtatacgtttggggtttcggngggttacgggacgttagttcgaaccgttccgttacggttcgaacgccgaacgcctcgccccgtccggttctaacccg

SEQ ID NO: 403159 - DNA, 637 bp, Homo sapiens
  misc_feature: GZ8MTXP01DKO4P.13.11.A11.1.454.CMB.2.raw
  modified_base (244)..(244): a, c, t, g, unknown or other
  modified_base (344)..(344): a, c, t, g, unknown or other
  modified_base (371)..(371): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtacccganagaagccagggagtcctccccagtttctcctgaggttcaggtcaactcagataaacgacaggctctggacgtccccagccgcttctctggactccaaggntgacttcccgcaacgcagggatatacncatctctgggctccagtctgacgatgaggtctagacttatttaccgttggggtttttacgacgttttacgggcctaaaccgaaaccgtaaccggacccttagggaactttcccggtttaccgggacccgttacggggtaacccaaccgggttccgtaaccccggttccgtaaacgggttcccaaccgggttccccgaaaacggggcccccaaaaccccctaacgttaccggtccttaacccgtttccttccggttttaaccccccc

SEQ ID NO: 403160 - DNA, 650 bp, Homo sapiens
  misc_feature: GZ8MTXP01EZ3DN.13.11.A11.1.454.CMB.2.raw
  modified_base (262)..(262): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggaccgacagaacgcgagggacgtccncccctagttctcctgaggttcaggtcaaactcagaataaacgacaggctcgtggacgtcccacgccgtcttctcgtaggactaccgaaggtatgtacttacccgacgaaccggcgaacgggtactactttacctacaattcctcgtcggggccttaccgtagttccgtaggtaaccgtagtacgggtacgggtacttaggtaactttaacgtttaacgtttgggttttacgtaacggtttacggacctaaacgaaaccgaaaccgtccgtagggacttcgttaccgggaccgttggggaaccctaacggttccgacccgttcgtacgggtaccacgacccgaacggtaacccaacccctaacgtcgtccactcccgttcggttccccc

SEQ ID NO: 403161 - DNA, 740 bp, Homo sapiens
  misc_feature: GZ8MTXP01D1G2O.13.11.A11.1.454.CMB.2.raw
  modified_base (256)..(256): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttggtcctatgacatatattggtaccacagagcgagggagtccncccagttctcctgagttcaggtcaaactcagaataaacgacgagggctcgtggacgtccccagtccgtctttctcgtcggacctaccgaaagggtactacggtaacctttaccccgggacccaaccgggtccgtaaacgggggtaaactttaaacgtttaccgttacctaaacgtttcccttaccggttcgggggtcccttaccccgtaaggttccgtttaacgggaaaccggtaagttacgggaacggggtcttacggtaactttaagttttaccgtttaggggtttttacgaccgttttacgggacctaaaccgaaaccgtaaaccgtcccgttaagggtacttccggtttaccgggaccgtggggtaacccctacgggttcccgacccggtttccgtacgggttccaaccggccccgttaaacggcccctaaacccctaacgttccgtaccttacccgtttccgttcccgtttaacccccc

SEQ ID NO: 403162 - DNA, 670 bp, Homo sapiens
  misc_feature: GZ8MTXP01A9BP2.13.11.A11.1.454.CMB.2.raw
  modified_base (610)..(610): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttcctgttgctatttaaaggtgtcagtgtgaggtgcagctggtagagtcgtgggggaggtgtgggtacggccgtggggggtccctcgagactctcctgtgcaacctctggattcagtatttgatgagtatggcatacacgtgggtcccaccaaccgtccgaggggaacgggctgcgtaggtggtctcgtaggtaataaacgtggaatggtacgccagccaaactaactttgcgactagtacctcgtagggtacggaaacggggtccctaattacccaacctattccgtaacccaaggaacgacctagggtccgacccgtaaagtaaacccgttccgaactatccgtaagaacctaaagtcgaaacaggttccgagggtacggtacggaacggtaccgtaacccgggttctttaggttactttcggtaggttacgggttcggttaagggtttacccncggttaagggtcgggttaaccttacggggttaaaccgtttaacgggaaccgttaaagggg

SEQ ID NO: 403163 - DNA, 567 bp, Homo sapiens
  misc_feature: GZ8MTXP01AF7T9.13.11.A11.1.454.CMB.2.raw
  modified_base (198)..(198): a, c, t, g, unknown or other
  modified_base (483)..(483): a, c, t, g, unknown or other
  modified_base (505)..(505): a, c, t, g, unknown or other
tcagtcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccgaggggaaangccaccctctcctgcagggccagtcagattgtcagcagcaactacttagcctggtaccagcagagcctggccacggccccaggcctcctcatctacgatgtatcgaggacgaccatgacactccagacaggttcagtcggctaggtgggtctagggaacagcttcgactctacacctagtcacgcgagtacgtacggaaacctagaacgttactttgactttacttttattctacgtactaccgtagttacgttcggtaactgggttcgcttacgcctaaccttntctcttcttctcttccttcccncttgtcgtagttacgttcgttacgtcgagtcgggacggtcgggttacgtcgggaacgaaggg

SEQ ID NO: 403164 - DNA, 568 bp, Homo sapiens
  misc_feature: GZ8MTXP01CZYSO.13.11.A11.1.454.CMB.2.raw
  modified_base (350)..(350): a, c, t, g, unknown or other
  modified_base (383)..(383): a, c, t, g, unknown or other
  modified_base (544)..(544): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggactcctccccagtttctcctgaggttcaggtcaaactcagaataaacgacagggctcgtggacgtccccagccgtcttctcgtggactccaaaggntcgacttcccgacaacgcgaagggattactacnctatctcgtgggcctcgagtctggaacgtgtgacggtctagtaacttatttacgttgggtttacgacgtttggaccaacaaccgaacgtcctagggcttcgttccggaccgtgggaacctcggctaccgttcgtaggtcaacgcccaaaggcccaaacccntcgtccacttccttcgttaacccc

SEQ ID NO: 403165 - DNA, 398 bp, Homo sapiens
  misc_feature: GZ8MTXP01DWBTI.13.11.A11.1.454.CMB.2.raw
  modified_base (269)..(269): a, c, t, g, unknown or other
  modified_base (377)..(377): a, c, t, g, unknown or other
  modified_base (388)..(388): a, c, t, g, unknown or other
  modified_base (393)..(398): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaacctgaaagtctttgctacttttattctgtcaccagtatggtagtcaccgtanactttggccaggggaccaagctaggagatcaaagcgtaaactgtggctgcacctatctgtcttcattccttcccgcctatctgtaatagtacgtgacgtgaggcgggntggcaaggcgnatagnnnnnn

SEQ ID NO: 403166 - DNA, 757 bp, Homo sapiens
  misc_feature: GZ8MTXP01DQMX6.13.11.A11.1.454.CMB.2.raw
  modified_base (217)..(217): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctcgtgggcgaggagggcccaccatcaactgacaagaccagccagtagttgtttanacagctaccgacaaataggaactacttagtcttaggaaccaacaagaaaccaggacacgcctaccgtaagttaccttcgtttacgtgggccgtacccgtaaccccgggtaacgtccccgggggtccctacggaacccgtattaccgaggtcggccgagggtccgggggttcgtacgggggactaggttacctttaccacttactaccaaccctaaactcgaaggacctaccggtccctttacgacgggtctaggtaaagtggttggtcgggtacttaaggtttttaacttaccgttggttaacgaacggtaacttaaaattatttaactactttccccttaccgggttccccctttacgggtccggggtaaaccgggtttccgggaaaccccggaaagggggtaacccggtaaagggggtaactaaaacggtaaccgaaaacccggtaagttgggtacgggcctacggacctaaaccctggttcttcggttacctaaccgtacttccccggtttccccgattacgttccttggttaaacg

SEQ ID NO: 403167 - DNA, 724 bp, Homo sapiens
  misc_feature: GZ8MTXP01C87TN.13.11.A11.1.454.CMB.2.raw
  modified_base (236)..(236): a, c, t, g, unknown or other
  modified_base (252)..(252): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatatggacanagagcgaggactcccnccctagttcctctgaggttcaggtacaaactcaagaataaacgacgagggctcgtaggacgtccccagccgtcttctcgtggactaccgaaaggtactagacttacccgaccaacgcgtaaaggggtaacttaacttaccacgtaacttcccgttcgtaccggggtccttacccgtaaggttccgttaggaaaccggtaagttgggaacgggtccttaaggtaaacctttaagtttaaaccgtttggggttttacgtaaccgtttcgggaacctaaaccgtaaaacccaaccggtcccgttaggggtaaccttcccggtttaccgggacccggttacggggaaccccgtaacgggttacccgtaacccggttaccgtaaacgggtaccaacccgggacccccaaaccgggtaacccccaaaacccctcggttcccgtaccttaaccctttcccgttcccgtttaaccccccc

SEQ ID NO: 403168 - DNA, 340 bp, Homo sapiens
  misc_feature: GZ8MTXP01DMCPK.13.11.A11.1.454.CMB.2.raw
  modified_base (337)..(340): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaagactttgctactttatttctgtcaccagtatggaactgtggctgcaccatctgtcttcatccttcccgcctatctgatagtacgtgactgagcgggctggcaaggcgcataagnnnn

SEQ ID NO: 403169 - DNA, 614 bp, Homo sapiens
  misc_feature: GZ8MTXP01BO6IA.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccgacagaagccagggagtccctccccagtttctcctgaggttcaggtcaaactcagataaacgacagggctcgtggacgtccccagccgtcttctcgtggactaccgaaggatgacttcccgaccaacgcgaagggatacttactcactctcgtgggcctcgagtcgtgacgtatggaggtctagtacttagttacgttggggtttacgtacgtttggactaacaaaccgacgtccgtaggtacttccgttaccggccgtcgggaaccctacggttccgacccgttccgtaacgggtcccaccggccccgaaaccgggaaccccaaaacccccgtcttcggtacccttaccgtccccgtttccggtttcccccccg

SEQ ID NO: 403170 - DNA, 524 bp, Homo sapiens
  misc_feature: GZ8MTXP01DO3KL.13.11.A11.1.454.CMB.2.raw
  modified_base (487)..(487): a, c, t, g, unknown or other
  modified_base (507)..(507): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctcccagtttctcctgaggttcaggtcaaactcagataaacgacagggctctggagtccccagccgcttctctggactccaaggatgaacttccgccaaacgcagggatattactcatctcgtgggctcagtctagacgatgaggctgacttattacgtgtttgacttggctacaacaacgcctggtattcgtcggaccgtgggaccacggtcaccgtcctaggttcncgcccaaggcccaacccacncgttcaacttcgttccg

SEQ ID NO: 403171 - DNA, 678 bp, Homo sapiens
  misc_feature: GZ8MTXP01CE4G6.13.11.A11.1.454.CMB.2.raw
  modified_base (244)..(244): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttcgtcctatgactatatagttggtaccganagaagccgagggacgtccctccccagtttctcctgtagttcaggtcaaactcaagaataaacgacaggctcgtaggacgtccccagccgtcttctcgtacggactacgaaggtatacgtaacttcccgaaccgaaacgacgaaggggtaactacgttaacctctaacttctcgtgggcctccgagttcgtagacgtagtcgaggtctaggacttaagtttaccggttggtttacgaacgtttcgggaaccaaaccgaaacgtaaaccggtccgttaggtaccgttccgttaccgggacccggttaacggggtaacccaccggggttacccacccgggttacctaacgggttaacttccgaacccggtaaccccgtaaaaccggaaccccctaaaccccctacgttaccggtaacccgttaaccctttcccccgg

SEQ ID NO: 403172 - DNA, 517 bp, Homo sapiens
  misc_feature: GZ8MTXP01BK1PZ.13.11.A11.1.454.CMB.2.raw
  modified_base (466)..(466): a, c, t, g, unknown or other
  modified_base (483)..(483): a, c, t, g, unknown or other
  modified_base (498)..(498): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtcaactcagataaacgcaggctcgtggacgtccccagccgtcttctcgtggtactccgaaggatgacttcccgaccaacgcagggtatagtactcatctcgtggctccgagtctgacgatgagctgactattactggtttgacttggacacaacacgctaggctcgtcgacctgggaaccngttccacgttcgagtcncgccaggcccacccntcgcactcgttcgtccccg

SEQ ID NO: 403173 - DNA, 719 bp, Homo sapiens
  misc_feature: GZ8MTXP01A6AGO.13.11.A11.1.454.CMB.2.raw
  modified_base (192)..(192): a, c, t, g, unknown or other
  modified_base (219)..(219): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatcgtcccgtcgtcccccgganagacagcctacatcacctgctctgganatgtattgactaacgagtattggttctggtatcagcagaaggcacggccacgccccctgtaccctactctacttctttaacaaaacgtcccgagggtcccgtccccgtcggtccgggggtccctggacgtcgtacttcccgtccccgggtccttcccggctaccggtacgggaaaacccacgtcgtacctaccgttcgtaccgaccacgtaccgaccgggacccggggtaaccctacggtacccgttagttacggagttacgggacggttcttacggttccgttaccttcggtcggtaccgggacggggggtaccgggttaacggggaaacctaacggcgggtccgttcggtccggtttgggggttacccggggacgggtacggggaccctagggtccgtacggttaccggttcgttacgggaccgaccggttcccgacgggttccctcccggtcccccgtaagggttcccaccgttcccgttcccggttccccctcccg

SEQ ID NO: 403174 - DNA, 333 bp, Homo sapiens
  misc_feature: GZ8MTXP01DMZVK.13.11.A11.1.454.CMB.2.raw
  modified_base (329)..(333): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgattcaggaggaccactgacatcccagacaggttcagtggcagtggtctggggacagacttcactctcaccatcagcagactggaaacctgaagtactttgctactttattctgtcaccagtatggaactgtggctgcacatctgtcttcatctcccgcatctgatgtacgtgactgaggcgctggacaggcgcataagnnnnn

SEQ ID NO: 403175 - DNA, 339 bp, Homo sapiens
  misc_feature: GZ8MTXP01C8EQ8.13.11.A11.1.454.CMB.2.raw
  modified_base (329)..(329): a, c, t, g, unknown or other
  modified_base (336)..(339): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttatttctgtcaccagtatggaactgtggctgcaccatctgtcttcatccttcccgctatctgatagtacgtgactgagcggctggcaaggcncataagnnnn

SEQ ID NO: 403176 - DNA, 388 bp, Homo sapiens
  misc_feature: GZ8MTXP01C4LC5.13.11.A11.1.454.CMB.2.raw
  modified_base (357)..(357): a, c, t, g, unknown or other
  modified_base (381)..(388): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgtcggccatgggaccaaggtggaaatgaaacgaactgtggctgcaccatctgtcttcatcttccgcatcctgatagtacgtgaactgngcgggctggcaagggcgacatagnnnnnnnn

SEQ ID NO: 403177 - DNA, 561 bp, Homo sapiens
  misc_feature: GZ8MTXP01BF11V.13.11.A11.1.454.CMB.2.raw
  modified_base (380)..(380): a, c, t, g, unknown or other
  modified_base (400)..(400): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttctcctgaggttcaggtcaaactcagataaacgacagggctctggacgtccccagccgtcttctctggactccgaaggatcgacttcccgaccaacgcagggatattacnctatctcgtggcctcagtcngacgatggagctgacttattacgtgggtttgtacttggactacaacgaacgtcctagggacttcgtccggaccgttggggaaccctaacggttcacccgttccgtaaggtcccacggcccaacggccccaacccgaatcgccacctcgttccgtaaccccc

SEQ ID NO: 403178 - DNA, 602 bp, Homo sapiens
  misc_feature: GZ8MTXP01BVZJE.13.11.A11.1.454.CMB.2.raw
  modified_base (240)..(240): a, c, t, g, unknown or other
  modified_base (259)..(259): a, c, t, g, unknown or other
  modified_base (327)..(327): a, c, t, g, unknown or other
  modified_base (346)..(346): a, c, t, g, unknown or other
  modified_base (380)..(380): a, c, t, g, unknown or other
  modified_base (406)..(406): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccanagaagccgagggacgtccnccccagtttctcctgaggttcaggtacaactcaagataaacgacagggctcgtggactccccgagccncttctctggactccgaagntgacttacccgaccaacgcgaagggatacttacncgtatctcgtggctcgagtctgacgntgacgctagtacttatttacgttggtttagtacgtttggacctaaacgaaacgtaccggtcctagggtacttccggttaccgggaccgttcggggaacctacgggttcctaaacccggttccgtacggtcgaaccggccccgaaacggtcccccaaaccccgcttccggtaccaccttcccttccgtaaccccccc

SEQ ID NO: 403179 - DNA, 603 bp, Homo sapiens
  misc_feature: GZ8MTXP01DB214.13.11.A11.1.454.CMB.2.raw
  modified_base (192)..(192): a, c, t, g, unknown or other
  modified_base (364)..(364): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcgacctgctctggagatgtattgaactaagagtatggttctggtatcagcagaaggcaggccacgccccctgtcctactcattctttacaaaactccgaggccgcctcgtggggccctgacgcgtattccgtccccggctccgctcgtaggaaaccacngtcactctacgaccatcgacggccggaccagtcctagttcgaagtgacggtcttacgtccttacgttcgtacgtccgagggggtcggtaggggaaccaacgagtcggtcgcgttcggtcgggcggggacgggacccgtaggttccgtcggttaccggttcgttacggtccgacggttacccgacggttccgtcccggtccccgtcgttaccgccgttcctccgttcccccgtaaccccg

SEQ ID NO: 403180 - DNA, 614 bp, Homo sapiens
  misc_feature: GZ8MTXP01CLZA4.13.11.A11.1.454.CMB.2.raw
  modified_base (241)..(241): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctttgcttctcctggagcgtcagccagtctcacctgcaccttgcgcagtggcaccaatgttgtcctatgacatatattggtaccganagaagccagggacgtccctcccagtttctcctgagttcaggtcaaactcaagataaacgacagggctcgtggacgtccccagcccgtctttcctcgtggactacccccgaaagggtatcgaacttcccgaaccaaacggccgaagggtattaacgttacctcaacttctcgtcggggcctacgaacgtctacggacgtagttgacggtctagacttattacgtgtttacggacgtttggacctaacgaaccacgcctaggtactcgttaccggaccgtacgggaccctaacggtccaccggttcacggtaccacgttaccccgacggccccaaaccccgtcttcgtccacttccttccgttcccctaaccccg

SEQ ID NO: 403181 - DNA, 754 bp, Homo sapiens
  misc_feature: GZ8MTXP01DOBIY.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctccccagtttctcctgaggttcaggtacaaactcagaataaacgacagggctcgtggacgtccccagcccgtcttcctcgtaggacctaccgaaagggtactcggtaacttccccgacccaacggccgaaaggggtactttaaactttacctactaattcccgttacgttcggggcctcccgtaaggttcccttagggaaaccgtagttaggaacgggtcttacggtaaactttaacgtttaaccgtttgggggtttttacgtaaccgttttacgggaaccctaaaccgtaaaacccgaaaccggtccccgttaagggtaaacgttcccgttttaccgggaaacccggtttcggggaaaccccgtaccgggtttacccgaccccggtttcccgtaacgggtcccgaaccgggaccccgaaacgggaacccccaaaacccccctaacgtttcccgtaccttacccgtttcccgttcccgggtttccccccccg

SEQ ID NO: 403182 - DNA, 828 bp, Homo sapiens
  misc_feature: GZ8MTXP01AE7R5.13.11.A11.1.454.CMB.2.raw
  modified_base (241)..(241): a, c, t, g, unknown or other
  modified_base (260)..(260): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtccctatgacatatattggtaccganagaagccgagggactcccncccctagtttctccgtgaggttcaggtcaactcagaactaaacgacagggctcgtcggacgtccccagccgcttcgtcgtggacctccgaaggtactcgacgttacccgaccgaacggcgaaaggggtattaacgtttacctcgtaacttccgttaccggttacggggtcccttaccgtaacgggttccttacggggtaaaccggtagttacgggtaacggggtcccttaagggtaaaccttttaacgtttaacccggtttgggggtttttaacggtaacgtttttacggggaacccctaaacccttaaaacccgggaaacccggttcccggtttaacgggggtaaaccttttcccggggtttaacccggggtaaccccggtttacggggggaaacccccttacgggggttaccccgtaacccccgggtttaccggtaaaccggggttaccccgaacccggggttacccccccgttaaaacgggggtcccccccaaaaaccccggtccgtttacccgggttaccccttaacccgttttccccggtttaacccgtttaacccccccccg

SEQ ID NO: 403183 - DNA, 701 bp, Homo sapiens
  misc_feature: GZ8MTXP01EXHA2.13.11.A11.1.454.CMB.2.raw
  modified_base (263)..(263): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattcggtaccgacagaacgcgagggactcccncccctagttctcgtgtacgttcaggtacaactcaagaataaacgacgagggctcgtggacccgtccccgacgccgtcttccgtcgtaggaccctaccgaaaggtactcgtaccgttaccccgaccgtaaccggcggtaaaggggtaactttaacgtttacctactaacgtttcccgtaccggttcggggtacccttaccgtaacggttccgtaagggttaaaccgaggttacgggaacgggtaccttacggtaactttaacgtttaccgtttaggggtttacgtaacgttcgggaacctaaaccgaaaccgtaaccggtccgtaggtaccttcggtaccggtaccgtcgggtaaccgtaccgttaccgtaccgttacgtacggaccaccgacccgacggaacccaccctaacgtacgtccactccgttccgtaacccc

SEQ ID NO: 403184 - DNA, 610 bp, Homo sapiens
  misc_feature: GZ8MTXP01ERMP2.13.11.A11.1.454.CMB.2.raw
  modified_base (220)..(220): a, c, t, g, unknown or other
  modified_base (292)..(292): a, c, t, g, unknown or other
tcagtcacgtactacacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcatcatcgtctcctgcactggaaccngcactgatggtggtgtatactatgtctctgtatcaacaacaccaggacaaacgccccaaatcatctatttanagaagtctatttatccggccctgaggtatttctaactcgtacttctctcggacctccaagtcctagggaccaacgtaccggtccctacccgtcgaccctattcctcgtcgggcctccgaggtcctagaacgacgaggcttagtaatttacggttactggctagcctacaatactaaccaacctatacgaaacctacaacgtacggttacgtaacgggaaacgtacggggaaacccaaacggttcccgttaacccggttaaccgttaacggtaacccgtaacggaccccgaaacgggaacccccttaaacccctaacgg

SEQ ID NO: 403185 - DNA, 590 bp, Homo sapiens
  misc_feature: GZ8MTXP01BI7LI.13.11.A11.1.454.CMB.2.raw
  modified_base (373)..(373): a, c, t, g, unknown or other
  modified_base (382)..(382): a, c, t, g, unknown or other
  modified_base (563)..(563): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccggacagacagcctacatcacctgctctggagatgtattgactaacgagtatggttctggtatcagcagaaggcaggccacgccccctgtccctactcattctttacaaaactaccaggccggcccctcgtcgggggtccctggacgcgtacttccgtccccggcctccgcctcgtacgggaaacacngtccactcncgaccatcacggccgggacccagcctagtgagtggaggtctgtcttactctgtcgaggggcgtaggggaccacgagcgtgcgtcggttcgggcgggacggtaccgtagtccgtcgttaccggttcgttaacgggtccaacggccccgaacggttcccgtcccggtcccccgtcggtacccncccgttccgtcccgttccccgtccccg

SEQ ID NO: 403186 - DNA, 686 bp, Homo sapiens
  misc_feature: GZ8MTXP01BE7YH.13.11.A11.1.454.CMB.2.raw
  modified_base (242)..(242): a, c, t, g, unknown or other
  modified_base (259)..(259): a, c, t, g, unknown or other
  modified_base (289)..(289): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccganagaagcgagggactccnccccagttctctgaggttcaggtcaaactnagaactaaacgacaggctcgtggaccgtccccagccgtcttctcgtggacctccgaaggatgacttccgaccaacggcagggatacttactcattctcgtacgggcctcgtagtcctggacgtagtggaggtcttagaactttatttaaccgttggggttttacgtacgtttacggacctaaaccgtaaaccgaaaccggttccgtagggttaaccttcccgggttaacccggggtaacccgttcgggggaaccccggttaacccgggttcccgttaaacccccggttaccggtaaaccgggtttacccgaaccggacccccgaaaccggggtaaccccccaaaccccgtaaccgtcccgtacccttacccttccgtttccccgtttaacccccccg

SEQ ID NO: 403187 - DNA, 683 bp, Homo sapiens
  misc_feature: GZ8MTXP01DQNII.13.11.A11.1.454.CMB.2.raw
  modified_base (241)..(241): a, c, t, g, unknown or other
  modified_base (257)..(257): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcgtcctatgacatatattggtaccanagaagcgaggactccncccctagttctctgtaggtcaggtacaactcaagataaacgacgaggctcgtaggaccgtcccacgccgtcttcgtctcggactaccgaaaggatcgtacttcccgaccaacggcgtaaaggggtacttaacttacctcgtacttccgtcgtggggtccttaccgtagttctacggaacgagttaggacgggtcttagtaacctttagtttaaccgtttgggggtttacgtacggtttacgggaacctaaaccgtaaaccgaaccggtcccgttaaggtacgttccggttaccggaccgttcggggaaacccgtcgggttaccgtaccccgttaccgtaacgggtccaacccggaccccgttaaaccgggcccctaaaaccccgtcgttccgtaccttaccgtttcccgttcccggtttccccccg

SEQ ID NO: 403188 - DNA, 519 bp, Homo sapiens
  misc_feature: GZ8MTXP01C47IT.13.11.A11.1.454.CMB.2.raw
  modified_base (427)..(427): a, c, t, g, unknown or other
  modified_base (442)..(442): a, c, t, g, unknown or other
  modified_base (463)..(463): a, c, t, g, unknown or other
  modified_base (502)..(502): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaaagccagggatcctccccagtttctcctgaggttcaggtcaaactcagataaacgacagggctctggacgtccccagccgcttctctggactcccaaaggatgactttcccgacctaacgcaaggggattaattactcatctctgggctccagtctgacgatgagctgactattactggttnacttgcacaacgacncgtagatctcggctggaaccncggttcaccgttctaggtcacgccaacggccctaacccnctgcactcgcttccccg

SEQ ID NO: 403189 - DNA, 760 bp, Homo sapiens
  misc_feature: GZ8MTXP01CMTAT.13.11.A11.1.454.CMB.2.raw
  modified_base (202)..(202): a, c, t, g, unknown or other
  modified_base (225)..(225): a, c, t, g, unknown or other
  modified_base (239)..(239): a, c, t, g, unknown or other
  modified_base (261)..(261): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcgggaccccccggnagagtgtcaccatctcttgttcnggagcagtgccaangtcgggataattatgctattcnggtatcaacactcccaggaccgccccagctcctcatctaatagacaactaaccgagccggcccttacgacgggggtcccctaggacccccgtatttccgtcgttcggcccttaacccgaaacgttcccgtcgggaccctaccccttacgaccggtcccccttcccccgtacgggcccctaagtcccggtaacgggttccgggggaccccgtttccccgggggtacccggtaacgggaacgttcggggaacgggttccttaagggtacttttaacgtttaacccggttggtttacccgaagggttccggtttagggggaacttcgggtaaaccgacggttacccgttagggtaaaccgtttacgggttttcgggggttttaaccgggacggggttaacggggtaccgttaacgggtttccgaccccggttccgttcgggaccgaacggtaccccgtaagggtcccgtcccggttcccccgttcgggttaacccgttcccg

SEQ ID NO: 403190 - DNA, 397 bp, Homo sapiens
  misc_feature: GZ8MTXP01BCUY1.13.11.A11.1.454.CMB.2.raw
  modified_base (347)..(347): a, c, t, g, unknown or other
  modified_base (388)..(397): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttatttctgtcaccagtatggtacgtcacgtactactttggccaggggaccaagcgtggagatcaagcgaactgtggctgacactatctgtcttcactctcccgcatctgntgtacgtgactgacggcggcgtggacgaaggcgacgatagnnnnnnnnnn

SEQ ID NO: 403191 - DNA, 722 bp, Homo sapiens
  misc_feature: GZ8MTXP01DZZ2V.13.11.A11.1.454.CMB.2.raw
  modified_base (172)..(172): a, c, t, g, unknown or other
  modified_base (214)..(214): a, c, t, g, unknown or other
  modified_base (236)..(236): a, c, t, g, unknown or other
  modified_base (246)..(246): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtcgtccgtgtccccaggacagacagccagcatcactgctntagaaataatgacagataaatntactctgtancagcagagtcaggccacgtccctgtgctggtcatctatacaagtatcgacctaacggccggtaccccgtagaacggggaccttcccccccggtaggaacggtccgttaactttcccgtccgttacgggtcccttaacccgtaaacgttccggtaacggggtaaaccttccgaacgtcccctaaccgttctacggaacccagttaccgaacgggtacccgggaacccctaggggtacctaaggtaggtacgttacgggacgggttaccttaggtaaccctttagtttaaccgtggttaaccggaggggtacccgggttaggggaacctaaggccgtaacggcccgtaaccgttccggccccgttaccgttaaggttccgggtttacccgtttaacggggaccggttaccggggaaccctaacgggttcccgtaaccccggttaccgttaaccgttaacccgaaccggtaacccccgg

SEQ ID NO: 403192 - DNA, 633 bp, Homo sapiens
  misc_feature: GZ8MTXP01BJ327.13.11.A11.1.454.CMB.2.raw
  modified_base (296)..(296): a, c, t, g, unknown or other
  modified_base (346)..(346): a, c, t, g, unknown or other
  modified_base (608)..(608): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatatggtacacagaagccagggactcctcccagttctctgagttcaggtcaaactcaagaactaaacganagggctcgtggacgtccccaggccgtcttcgtcgtaggactccgaaaggntagactcccgacaacgcgaagggtactacttaccactcttccgtcgtcgggtccctacgtacgttgacgtaacgtaggtacggaccggttatacgttaaactttactttacggtttgggtttacgtacgttacggaccaaacgaaaccgtaccgtgttacgggtaacctttcgggtaaccggtcggaccggaacctacggttaccgtacccgttacgtacgggaaccacccggaacccacgaaccccaacctcggtttaccnccttaccgttccgttcccgtccccg

SEQ ID NO: 403193 - DNA, 606 bp, Homo sapiens
  misc_feature: GZ8MTXP01EMXMV.13.11.A11.1.454.CMB.2.raw
  modified_base (215)..(215): a, c, t, g, unknown or other
  modified_base (305)..(305): a, c, t, g, unknown or other
  modified_base (411)..(411): a, c, t, g, unknown or other
  modified_base (437)..(437): a, c, t, g, unknown or other
  modified_base (523)..(523): a, c, t, g, unknown or other
  modified_base (549)..(549): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactcctggctgtgtctcgtgggcgaggagggccaccatcaactgacaagaccagccagagttgttttanacagctccgaacaataaggaacttacttagcttaggaaccaaacaacgaaaccaggacacgtcctaccgtaaagttacttcgttttacgngggtcctacgtaaccccgggaagttccccggggtccctaggaccgtattccgaggtcgggcgagggtcgggtctaggggacagtactttcacgtctacaccaatcngtcacgtccttcgaggctagaaagtntggtggacttagtttatacgtgactagactaaattacttatatccttcgtcctcgtcggacgttcgacgaaaggtacgaaggggtnaaatacaaacggtaactggtacggcncggttacaccgtattccttgttccttcgacttcccttcccgacagttcgttgtaacg

SEQ ID NO: 403194 - DNA, 766 bp, Homo sapiens
  misc_feature: GZ8MTXP01COR8V.13.11.A11.1.454.CMB.2.raw
  modified_base (258)..(258): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattcggtaccacagagccgaggactccnccccagttctcctgagttcaggtacaaactcagaactaaacgacgaggctcgtaggacgtccccagccgtcttctcgtggaacctaccgaaaggtatacgtaacttaccccggaaccaaccggacgtaaggggtaaacttaacttaccgtactaacttccgttacgttcggggtaccttacccgtaaggttccttagggaacgtagttacggacgggtcttaacggtaacttaacgttttccgtttaggggttttacgtaaccgtttcgggaaccctaaaccgaaaaccgtaacccggtccgttaaacggggtacctttcccggttaccggggtaaccccggttcgggggtaaaccccgtaacggggttacccgtaaaccccggttaccggttaaacggggttccccaaacccgggacccccgttaaaaccgggtaacccccaaaacccccttcgttaccgggtaccccttaaccgtttccccgttccccgggttttaaccccccccg

SEQ ID NO: 403195 - DNA, 579 bp, Homo sapiens
  misc_feature: GZ8MTXP01ETGLC.13.11.A11.1.454.CMB.2.raw
  modified_base (243)..(243): a, c, t, g, unknown or other
  modified_base (384)..(384): a, c, t, g, unknown or other
  modified_base (420)..(420): a, c, t, g, unknown or other
  modified_base (430)..(430): a, c, t, g, unknown or other
  modified_base (435)..(435): a, c, t, g, unknown or other
  modified_base (527)..(527): a, c, t, g, unknown or other
  modified_base (572)..(572): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcttgggttttccttgttgcttattttaaaaggtgtccagtgtgaggtgcagctggtagagtcgtgggggagtgtggtacggccgtgggggtccctnagctctcctgtgcaacctctggattcagtattgatgagtatggcatacacgtcgggcccgacccaaccgtccgaaggggacgggctgcgaggttggtctcgtaggtaataaacgtggaattggcgccagccaaacaacttntgacagctcgtaggagaacgggcctattccgaactntccacgaganaccgngtacgaccgaagtaccctccgtaacactcgtagaacaaagtcgaaacgtgtaccgcggtagtccggagccgtaacggttcttgttactttgnggtcgcggttaggttgcgtagtcggtacgttacggttactaacgngtaacgg

SEQ ID NO: 403196 - DNA, 584 bp, Homo sapiens
  misc_feature: GZ8MTXP01DVT53.13.11.A11.1.454.CMB.2.raw
  modified_base (191)..(191): a, c, t, g, unknown or other
  modified_base (219)..(219): a, c, t, g, unknown or other
  modified_base (425)..(425): a, c, t, g, unknown or other
  modified_base (454)..(454): a, c, t, g, unknown or other
  modified_base (484)..(484): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatgtcccgtcgtcccccgganagacagcctacatccacctgctctgganatgtattgactaacgagtattggttcctggtatcagcaggaagcaggccacgcccctgtcctactcatctttacaaaactccgaggccgtcctcgtcggggtccctgacgtcgattccgccccggcctccgcctcgtagggaaaccactcgtcactctcgaccatcgacgccgggaccagtcctagtgatggagtctgtctacttntacgtcgagggggcggtaggaacaacggngtcgtgtcgtcggtcgggacggacggtcgnggttcgtcgttaccggttcgttacggaccgaccggttaccgacggttccgtcccggtccccgtcggtccctccgttccgttcccggttccccgtaacccg

SEQ ID NO: 403197 - DNA, 623 bp, Homo sapiens
  misc_feature: GZ8MTXP01CG3UI.13.11.A11.1.454.CMB.2.raw
  modified_base (258)..(258): a, c, t, g, unknown or other
  modified_base (267)..(267): a, c, t, g, unknown or other
  modified_base (283)..(283): a, c, t, g, unknown or other
  modified_base (326)..(326): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttggtccctatgactatatagtacggacagagacgcgaggctcccnctctctcgngtgtcgacgtacacanagaacaacgagacgtctgacggtaccctaccgcgcctctctgngtaccacgagtcgtataccgtacccacgaacgacggtagtattactactactactctggtcgtcctacgtactcgacgacgtaggtcggacgttcgaccgttaattacgtttacggtttggggttacgtacggggtttcaaccgtaaactaaacccggtaccgtacggttacgtaaccgtttccgggtacccggtacgggtaccggaacccggtacgttacccggtccgttacgtaccggcacccgttacgaccgaaccccactgtcccgaccttcgttccgttccccgttaacccc

SEQ ID NO: 403198 - DNA, 555 bp, Homo sapiens
  misc_feature: GZ8MTXP01AIB7L.13.11.A11.1.454.CMB.2.raw
  modified_base (214)..(214): a, c, t, g, unknown or other
  modified_base (236)..(236): a, c, t, g, unknown or other
  modified_base (473)..(473): a, c, t, g, unknown or other
  modified_base (495)..(495): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcactgctntagaaataatggacagataatntactctgtatcagcagagtcaggccagtcccctgtcgctggtcatctatacaagatcgaccgaacggccggccctacgacgggactccccccgtggagtcgtattctacgtcggcctaccaaacgttcgtacgggaacctcacgcccactctacgaccagtccgacggaccgggacccaggacctagtaggagtggagcgtagtaccttattaccgtgtccgagggccgtagggacngacgacgtcaacgtcgcccgtnttacgtcgtcgttacggacgttcgggaaccaggtccaccgtacgttacgtcgcgaacccg

SEQ ID NO: 403199 - DNA, 576 bp, Homo sapiens
  misc_feature: GZ8MTXP01ELHP0.13.11.A11.1.454.CMB.2.raw
  modified_base (259)..(259): a, c, t, g, unknown or other
  modified_base (417)..(417): a, c, t, g, unknown or other
  modified_base (554)..(554): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtcctatgacatatattggtaccgacagaagccagggacgtcccnccccagttctcctgaggttcaggtacaaactcaagaataaacgacagggctcgtggacgtccccagcccgtcttctcgtaggactaccgaaagggtatggaacttcccgactaacgacgaaggggtaattacttactcactctcgtggctccgagtcngtacgatgagctagacttattacttggggttctacgtttggactaacaacgaacgtccgtaggactcgttccgggaccttgggaaccctacgggttcccaccgttaccgtggacacgcccaacggaacccaaccccnctcgtcactccgttccgtcccc

SEQ ID NO: 403200 - DNA, 345 bp, Homo sapiens
  misc_feature: GZ8MTXP01D8MLG.13.11.A11.1.454.CMB.2.raw
  modified_base (335)..(345): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcactagtatggaactgtgctgcacatctgtctcactcttccgctatctgatagtacgtgactgaggcggctcggacaaggcgcagtaagnnnnnnnnnnn

SEQ ID NO: 403201 - DNA, 542 bp, Homo sapiens
  misc_feature: GZ8MTXP01CM1RK.13.11.A11.1.454.CMB.2.raw
  modified_base (222)..(222): a, c, t, g, unknown or other
  modified_base (280)..(280): a, c, t, g, unknown or other
  modified_base (307)..(307): a, c, t, g, unknown or other
  modified_base (314)..(314): a, c, t, g, unknown or other
  modified_base (362)..(362): a, c, t, g, unknown or other
  modified_base (493)..(493): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccganaataggaactatagcttggacaacagaaaccaggacagcctcgaagttactctttacngggctcgtacccgggatccggggtccngaaccgnttcagtggcaggcggtctggggacagtactttcactctacaccaatcngcacgccttcgagggctaggaagtatggtaggctagtttactacgtgtacagactaatattatatctcgtccctcgtcggacgttcggaccgaagggaccgaagggtagaaactacgaaacgactggtcgntcgctacattcgttgttcttcacttccttcccgcttacgttcgcgtaag

SEQ ID NO: 403202 - DNA, 584 bp, Homo sapiens
  misc_feature: GZ8MTXP01CWK54.13.11.A11.1.454.CMB.2.raw
  modified_base (258)..(258): a, c, t, g, unknown or other
  modified_base (270)..(270): a, c, t, g, unknown or other
  modified_base (289)..(289): a, c, t, g, unknown or other
  modified_base (345)..(345): a, c, t, g, unknown or other
  modified_base (375)..(375): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgctttctcctggagcgtcagccagtctcacctgcaccttgcgcaatggcaccaatgttgccctatgacatatattggtaccacagaagccgaggatcccnccccagtttccnctgagttcaggtcaaactnaagataaacgcgaggctacgtggacgtccccagccgcttctctgacctaccaaggntgacttcccgacaagcagggatacgttacncatcgtcgtcgacctcgagtcgtagacgtgtacgacgtctagtaacttagttacgttgggttacgtacgttacgaacctaacgaaccgtacgtcgtacggtacttccggtaccggaccgtcggaacccgtacggttcctaccgttcgtacgtccaccgcccgacggaaccccaccctcgtcgtaccttaccttcccgttaaccgtcccg

SEQ ID NO: 403203 - DNA, 645 bp, Homo sapiens
  misc_feature: GZ8MTXP01EGOSS.13.11.A11.1.454.CMB.2.raw
  modified_base (272)..(272): a, c, t, g, unknown or other
  modified_base (448)..(448): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtcctatgactatatattcggtaccacagaagccgagggactccctccccagtttccncctaggaggttcaggttacaaactcaagaactaaacgcaagggtctacgtcggactccccagcctcttctcgtcggactaccgaaggtatcgacgttcccgacaacgcgaagggtaacttactttacctactaacgttccttcgtacggggaccttacgaagttccgtagaaacgngttaggacggtctagtaacgttatttacgttggttacgtcttacggactaacgaacgaaccgtctacggtacttccggtacggtaccgttcgggaaccgtaacggttccgacccggttaccgtacgggtcaaccggccccgttaaaaccggccccaaaccccgtgtacccgtacaccttccgttcccgttaaccccc

SEQ ID NO: 403204 - DNA, 635 bp, Homo sapiens
  misc_feature: GZ8MTXP01C5EHP.13.11.A11.1.454.CMB.2.raw
  modified_base (173)..(173): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagcccaccctnagtgtccgtcgtccccaggacagacagccagcatcacctgctactaggaaataaagtggacaagtaattaaattactacttcctaggtatacagcaagaagtcaggccacgtcccctgtgctggtctatctatacaagatcgaccaacggccgcccctacgagggactcccccgtggacgcgtacttctccgtcgcctaccacgtacgtacgggaactcgacgcccactcgacgtaccactaccgacgggacccggtaccgaggtacgtagtagtacgtaggacgtacgttacgtacgttaacttacgtgtaccgaagggttccggtacgggacgtacgcgtacgccgtaacgttccgccccggtattacgttaccggttccgttaaccgggacgttaccgggtaaccgtaaacggttccgtaaacccggttaccgttaacgtcccgaaccgaaacccccgg

SEQ ID NO: 403205 - DNA, 340 bp, Homo sapiens
  misc_feature: GZ8MTXP01CGKGK.13.11.A11.1.454.CMB.2.raw
  modified_base (274)..(274): a, c, t, g, unknown or other
  modified_base (303)..(303): a, c, t, g, unknown or other
  modified_base (334)..(340): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgctacttttattctgtcaccagtatggaactgtggctgcacatctntcttcattcctcccgcatctgatagtacngactgacgcggctcggcaggcgcagtaacgnnnnnnn

SEQ ID NO: 403206 - DNA, 854 bp, Homo sapiens
  misc_feature: GZ8MTXP01CQNNF.13.11.A11.1.454.CMB.2.raw
  modified_base (238)..(238): a, c, t, g, unknown or other
  modified_base (255)..(255): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgttgtcctatgacatatattggtaccganagagcgagggactcccnccctagttctcctgacggttcgaggtacaaactcgaagaactaaacgacgagggctcgtacggaccgttaccccacggtcccgtctttaccgtcgtacggtaacccttacccggaaaagggtacttacggtaaccgtttacccccgggaacccgtaaaccggtccggtaaacgggggtaaactttaacgtttaacccgttactaaacgttacccgttaccggttacgggggtcccttacccccggtaaaggtttccgttaacggggtaaaccggttaacgttagggtaaccggggtaccgtttaacgggtaaaccttttaaacgtttttaacccggttttagggggtttttaacggtaaccggttttacggggaacccctaaaaccgtaaaacccggtaaacccggtcccggtttaagggtaacctttcccggttacccggggtaaccggtttaccgggggaaacccccgtacgggttacccgtacccgttaccggtaacggttcccgaacccggttccccgaaaccgggaaccccctaaacccccgtaacgttcccggtacccttaccgtttccccgtttccgggttttccccccccg

SEQ ID NO: 403207 - DNA, 652 bp, Homo sapiens
  misc_feature: GZ8MTXP01BDIPE.13.11.A11.1.454.CMB.2.raw
  modified_base (357)..(357): a, c, t, g, unknown or other
  modified_base (392)..(392): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccacagaagccaggacgtccctcccctagtttctcctgaggttcaggtacaaactcagaataaacgacgagggctcgtggacctccccagccgtctttctcgtggacctaccgaaaggtntagtacttcccgaccaacgcgaagggattattacnctatctcgtggctcgagtctgacgtatgacggctgaacttattacgttgggtttcgtacgtttcggacctaacaaaccgtaacgtccgtacggtaacttcccgtttaccgggaacccgtcggggtaaccccgtaccggttaccgtacccggttaccgttaacgggtacccgaaaccggttcccccgaaaacgggtcccccaaaaccccccggtcttccggttacccttaacccgttcccttcccgggttttaaccccccc

SEQ ID NO: 403208 - DNA, 556 bp, Homo sapiens
  misc_feature: GZ8MTXP01EF4ZM.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtcctatgacatatattggtaccacagaagccagggagtccctccccagtttctcctgaggttcaggtcaaactcagataaacgacagggctcgtggacgtccccagccgcttctctggactccaaggatgactccgccaacgtcaagggatatactcatctcgtggctcgagtctgacgatgaggtctagacttagttacttgggtttcgaacgtttggacaacgaacgaaccgtccgtaggtactccgttacggacgttcggggaacctacgggttccaccgttcgagggtccacggcccaaggccccaaacccgctacgtccacttcgttcgttccccc

SEQ ID NO: 403209 - DNA, 709 bp, Homo sapiens
  misc_feature: GZ8MTXP01CWW8S.13.11.A11.1.454.CMB.2.raw
  modified_base (257)..(257): a, c, t, g, unknown or other
  modified_base (346)..(346): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacatgttgtcctatgacatatattggtaccgacagaagccagggacgtccnccccagtttctcctgaggttcaggtcaaactcagataaacgacagggctcgtggacgtccccagcccgcttctctggactccgaaaggntacgacttccccggaccaacggccgaaggggtacttacttacctctaatcctacgtggggcctcccgagttcctaggaccgtattcgggacgggtccttagaaccttaatttaccgtttggggttttacgtaaccgtttcggggaaccctaaaccgaaaaccgtaaccggtccgttacggggtaacttcccggtttaccggggaccccgttacgggggtaacccctaccggggttcccgtaaccccgggtttcccggtaaaggggttccccaaccgggttacccccaaaacggggtccccccaaaaacccccgtccgttacggttccccgttaacctttcccgttcccggttttccccccccg

SEQ ID NO: 403210 - DNA, 554 bp, Homo sapiens
  misc_feature: GZ8MTXP01C4FOH.13.11.A11.1.454.CMB.2.raw
  modified_base (360)..(360): a, c, t, g, unknown or other
  modified_base (375)..(375): a, c, t, g, unknown or other
  modified_base (528)..(528): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggtttccttgttgctattttaaaggtgtccagtgtgaggtgcagctggtagagtcgtgggggaggtgtggtacggccgtggggggtccctcagactctcctgtgcaacctctggattcagtatttgatgagtatggcatacactgggtccgccaacctccgaggggaagggctgcgaggtgggtctctggtaataaacgtggaactggtnccagcaaacaacttntgcagactcgtgtgaagggccctattccaccatcctacaagacgacaggtcgacccgaagaacctcccgtaacaatccgtagaccaaaagtgaaactgtacctgggagtacgagggacctaacggtctttgtacttcgtgtgacgttggttanctaggtgctgggttacttcgcgtaag

SEQ ID NO: 403211 - DNA, 743 bp, Homo sapiens
  misc_feature: GZ8MTXP01ANXDY.13.11.A11.1.454.CMB.2.raw
  modified_base (202)..(202): a, c, t, g, unknown or other
  modified_base (243)..(243): a, c, t, g, unknown or other
  modified_base (275)..(275): a, c, t, g, unknown or other
  modified_base (429)..(429): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgccttctcctggagcgtcagccagtctcacctgcaccttgcgnagtgcaccaatgttggtcctatgacatatattggtaccganagaagccgaggtacgtccctcccgtagtttcncctgaggttcaggtacaaactcaagaataaacgacgaagggtctacgtacgggaccgtccccgagtcccgtctttcctcgttacggggaacttaccgaaaggtacttacgaacgttccccgaaccgaaacgtcgaaagggtacttacgtttacnctaacttcctacggtcgggcctaccgtaagttcgtacggaacgtagtacgggaacggtccttaggtaactttacgtttaaccgtttgggttttacgaacgtttaccgggaaccaaaccgtaaaccgtaacccggttccgttaggtaaccgtttccggttaacccgggaccccggttaacggggaaccccttacggggtaccccgttacccgggttacccgttacgggacccgttaccggaaacccccgaaacgggacccccctaaaaccccgtcgttccggttacccttaacccggtttcccgtttaacccccg

SEQ ID NO: 403212 - DNA, 701 bp, Homo sapiens
  misc_feature: GZ8MTXP01D9R1X.13.11.A11.1.454.CMB.2.raw
  modified_base (241)..(241): a, c, t, g, unknown or other
  modified_base (327)..(327): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtcctatgacatatattggtaaccanagaagccagggacgtcctcccagttctcctgagttcaggtacaaactcaagataaacgcaggctctggacgtccccagccgtctcnctggactaccaaggatgacttacccgaccaacggcaacggggattaacttacctactaacttccttcgtacggggtccttaccgacgttaccgttaggaaaccggtagttacggacgggtacttacggtaaaccttagtttaaccgtttggggttttaacgtaacgtttcgggaccaaccgtaaaacccgacggtaacccgttggtacttaacccggtttccgggaacccggttcgggggaacccctacgggttcccgtaacccggttccccgtaaagggttcccaaccgggccccaaaccggggaacccccctaaaccccgtaaccgttccgtacccttaaccgttccccgtttaaccgtttaaccccccccg

SEQ ID NO: 403213 - DNA, 569 bp, Homo sapiens
  misc_feature: GZ8MTXP01BH927.13.11.A11.1.454.CMB.2.raw
  modified_base (172)..(172): a, c, t, g, unknown or other
  modified_base (236)..(236): a, c, t, g, unknown or other
  modified_base (339)..(339): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtcgtccgtgtccccaggacagacagccagcatcacctgctctagaaataatgacagataatntactctgtatcagcagaagtcaggccacgtcccctgtcgctggtcagttctatacaagatcgaccaagccggcctacgaggactccccctggacgtcgattcncgtcggcctacctaaacgtagtacgggtaactacgacgtaccctactctacgaccactacgacggtaccggacccaggcctagtggataggacggtctaggtaacttagtacgtcggtacgtcgggacgtacgggactaggacacgcaacgtcgacccgtgttacgtcgtacgttacgggacttacgggaaccacggtcctaccggtacttaacgtccgaacgaaccccg

SEQ ID NO: 403214 - DNA, 602 bp, Homo sapiens
  misc_feature: GZ8MTXP01BED1D.13.11.A11.1.454.CMB.2.raw
  modified_base (259)..(259): a, c, t, g, unknown or other
  modified_base (346)..(346): a, c, t, g, unknown or other
  modified_base (379)..(379): a, c, t, g, unknown or other
  modified_base (566)..(566): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtccctatgacatatattggtaccgacagaagccagggactccnccccagttctcctgaggttcaggtcaaactcagataaacgacgagggctctggacgtccccagccgtcttctctggactccgaaggntgacttacccgccaacgcgagggatacgttacncatctacgtggctccagtctgacgatggagctgaacttatttacgtgggtttcgtaacgtttggaccaacgtaaccgaacgtcctagggtacttccgttaccggacccgtgggaacccctaacgggttccgtaacccggttccgtacggtcccgacgttaccccgaacgggcccccaaacccccgtnttaccggtccttaccttccgttaaccgtttcccccc

SEQ ID NO: 403215 - DNA, 643 bp, Homo sapiens
  misc_feature: GZ8MTXP01A2UEZ.13.11.A11.1.454.CMB.2.raw
  modified_base (400)..(400): a, c, t, g, unknown or other
  modified_base (405)..(405): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttctcctgaggttcaggtcaactcagataaacgacagggctcgtggacgtccccagccgtcttctcgtggactccgaaggatgacttcccgaccaacgcagggatacttactcatctcgtggctcgagtcngacgntgaggctgaacttattaccgttgggtttacgtacgtttaggacctaaacgaaaccgtaacgtcccgttagggtaacttccggtttaccgggacccgttcgggggaaccctaccgggttccgaccccggttaccgtaacgggttcccgaacccggccccgaaaccggggtaacccccaaacccccgtaaccgttaccggtacccttaacccttcccgtttccccgggtttccccccccg

SEQ ID NO: 403216 - DNA, 609 bp, Homo sapiens
  misc_feature: GZ8MTXP01DG0GB.13.11.A11.1.454.CMB.2.raw
  modified_base (295)..(295): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagaataaatatacttctggtatcagcagaagtcaggccacgtcccctgtgctggtcatctatcaagntcgacaagccgccctagagggactcccccgtgacgcgtattctacgtggcctcaaacgtctacgggaactcgacgccactcgtacgaccatcgacggaccgggacccaaggtcctagacggattacgggacggcgtacggtacttaacgttacgtgtcggacggtcggtaggggactacggcgacggccaacgtcggttcccggtacttacgttacggttccgtttaacggggaccgttacggggtaaccccggtaaagggttccccgtaacccggttaccgttaaacggtaaccccgaacggtaaccccccgg

SEQ ID NO: 403217 - DNA, 527 bp, Homo sapiens
  misc_feature: GZ8MTXP01EXUV7.13.11.A11.1.454.CMB.2.raw
  modified_base (260)..(260): a, c, t, g, unknown or other
  modified_base (393)..(393): a, c, t, g, unknown or other
  modified_base (397)..(397): a, c, t, g, unknown or other
  modified_base (507)..(507): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagtttctcctgaggttcaggtcaaactcagataaacgacagggctctggacgtccccagccgcttctctggactccaaggatgacttcccgccaacgcagggatattactcatctctgggctccagtcngacntgaggctgacttattactgggtttgacttggctaacgaacaacgcctggactcgttcggacctgggaaccacggttcaccgttcgtaggtcacgcccacggcccaacccnctcgcactcgttcgttcccc

SEQ ID NO: 403218 - DNA, 685 bp, Homo sapiens
  misc_feature: GZ8MTXP01ETI6S.13.11.A11.1.454.CMB.2.raw
  modified_base (192)..(192): a, c, t, g, unknown or other
  modified_base (253)..(253): a, c, t, g, unknown or other
  modified_base (334)..(334): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcacgccaccctcatcgtccgtcgtcccccgganagacagcctacactcacctgctcgtggatatgtatagaactaagagtagttgttctggtancgagcgagaagcgacggccacgtccccctgtacctctctacttcttaacaaactccgacggccggtcctcggtcgggtccngacgcgtactccgtcccgccgtcgccgtcgtacggaaacacgtcgtctactcacgacctacgcgacggaccggaccacgtctagtgagtaggtacgtcttcggtacttaccgtcgttacggtacggacgggggttcgggttaacggggaacgaaccgttcggtccggtttcgggtccggtttacgggggttcccgggggaacgggggttaccgggaacccgtcgggttaaccggttacggttaccccgggtttaggttaccgttaccggaccggttaacccggacggttccccgtccccgggttcccctaacgggttccctccgttcccgttccccgttccccgtaacccg

SEQ ID NO: 403219 - DNA, 559 bp, Homo sapiens
  misc_feature: GZ8MTXP01DXV2M.13.11.A11.1.454.CMB.2.raw
  modified_base (188)..(188): a, c, t, g, unknown or other
  modified_base (199)..(199): a, c, t, g, unknown or other
  modified_base (361)..(361): a, c, t, g, unknown or other
  modified_base (409)..(409): a, c, t, g, unknown or other
  modified_base (443)..(443): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctctatgagttgactcagccaccctcatgtccgtgtcccccgganagacagcctanatcacctgctctggagatgtattgactaagagtatggttcctggtatcagcagaaggcaggccagccccctgtccctactcatctttacaaaataccaaggcggcccctctcgggggtccctgacgcgacttcctccccggctccgctcgtcgggaaacacngtccaactctgacccatcaacgcgggaccacgcctattgatgaggtcngtctacttctgtcgaggggcgtgggacaaacggngcgtgcgtcggtcgggcggtaacggcctggtcgtcggttaccgtcgttacggtacgacgacccgacggttccgtccgccccgttcggtcctccgttccgttccgttccccgtcccg

SEQ ID NO: 403220 - DNA, 605 bp, Homo sapiens
  misc_feature: GZ8MTXP01DYVXB.13.11.A11.1.454.CMB.2.raw
  modified_base (237)..(237): a, c, t, g, unknown or other
  modified_base (253)..(253): a, c, t, g, unknown or other
  modified_base (578)..(578): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttgtcctatgacatatatggtaccanagaagcgaggactccnccctagttctcctgaggttcaggtacaaactcagataaacgacgagggctcgtaggaccgtccccgagccgtcttctcgtacggactaccgaaaggatacgtacttaccccgaccaacggacgtaagggtattacttactctacttccgtcgtcgggccttccgagttcctaggtaacgagttcggaaggtctacgtaactttattacgttgggtttacgtacgttcggactaaacaaccgtaaccgcgttaggtacttccgtaccggtacgtcgggaacctcggttcctaccgttcgtacggtcacgcccaacggcccaacccngtcgacaccttcgttccgttaaccccc

SEQ ID NO: 403221 - DNA, 676 bp, Homo sapiens
  misc_feature: GZ8MTXP01CRN6E.13.11.A11.1.454.CMB.2.raw
  modified_base (646)..(646): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcgcagtggacacctaagttgttcggtccctatgaactattatagttacggtaccgaacaggaaacgccgaagggtacctcccctccccgtaagtttcctccgtaggtacggttcgaacggttacaaaactcgaaagtaactaaaaccgacgacggggtctacgtaggacccgtccccgagtcccgtcttctcgtacggaactaccgaaaggtctacggaacttaccccgaccaacggcgtaaagggtaacttaacttacgtacattcccgtgtacgggcttaccgagtcctaggacgtagtgacggactagtaacttaagtttcttggggtttagtacgttaggaccaaacgtaacgaaccgcgtagtacgtccgttaccggacgtacggaacccgtacgttcgtacccgttacgttacgaccacgacccaacggcccctaaaccccncgtctaccttaccttccgttccggttcccc

SEQ ID NO: 403222 - DNA, 416 bp, Homo sapiens
  misc_feature: GZ8MTXP01C0VFD.13.11.A11.1.454.CMB.2.raw
  modified_base (368)..(369): a, c, t, g, unknown or other
  modified_base (405)..(405): a, c, t, g, unknown or other
  modified_base (410)..(416): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagtacttcactctcaccatcagcagactggaacctgaagtactttgacttacttttatttcctagtccaccgtagttagtggtacggtccaaccgttactacgttttcgggccgtaggggaacccaagctaggagatacgaagcgaactgtggctgcacatctgtctcactctccgcatctnntagtacgtgactgacggcgggctggcgtaaggcganatagnnnnnnn

SEQ ID NO: 403223 - DNA, 734 bp, Homo sapiens
  misc_feature: GZ8MTXP01EKAYV.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgactatatattggtaccgacagaagccgagggacgtccctccccagtttctcctgtacggttcaggtcaaactcaagaataaacgacgagggtcctacgtcgggacgtccccgagcccgtcttccgtcgtcggactaccgaaggtactcggtaacttcccgaaccaaacggtaccgaaggggtacttaagttaacctctaacttccttcgttcggggaccttccgtaacgttcgttacggaacgtagttcgggacggttactaggtaactttagtttaacggttggttttacgtaccgtttgggaccaaaccgtaaaccgaaccggttaccgtacggtaacgttcccggtttaccgggtaacccgtcggggtaaccccgttacgggttaccccttaacccgggttaccgtaacgggttaccgaaacccgggacccccgaaaaccgggtacccccctaaaacccccctcgttaccggttaccctaacccggtttcctttaacccccccgg

SEQ ID NO: 403224 - DNA, 602 bp, Homo sapiens
  misc_feature: GZ8MTXP01CJSD4.13.11.A11.1.454.CMB.2.raw
  modified_base (194)..(194): a, c, t, g, unknown or other
  modified_base (222)..(222): a, c, t, g, unknown or other
  modified_base (237)..(237): a, c, t, g, unknown or other
  modified_base (377)..(377): a, c, t, g, unknown or other
  modified_base (406)..(406): a, c, t, g, unknown or other
  modified_base (438)..(438): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagcctacatccacctgctctggantgtatgaactaacgngtatggttcctggtatcgagcaaggaaggcacggccacggcccctgtcctactctattcttaacaaaactaccgacggccggtccctcgtcggggtccctgacgcgtactccgtccccgcctcgcctcgtacggaaaccnctgcactctcgacactcgacgccgtaccncgtctagtcgatggacgtctggtctacttcgngtcgacgggggtcggtacgggaacaacgcgtcgtcgtcggttcgggtcggcgggtacgggaacctggtaaccgtcggttacggttccgttacggacgtccggacccgaggttccctccggtcccccgtggtccctcgttcccgttcccgttaaccccgtccccg

SEQ ID NO: 403225 - DNA, 691 bp, Homo sapiens
  misc_feature: GZ8MTXP01ELB56.13.11.A11.1.454.CMB.2.raw
  modified_base (214)..(214): a, c, t, g, unknown or other
  modified_base (293)..(293): a, c, t, g, unknown or other
  modified_base (429)..(429): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctcgtgggcgagagggccaccatcaactgcaagaccagccagagttgttttanacagctccgacaataggaactacttagcttggtaccaacagaaaccaggacagacctaccgtaagttactcttttacgngggccgttccgtaaccccgggaagttccccggggtaccctgacccgtatttccgaggtcggacaggcgggtctggggacagtactttcgactcgtaccaccaatcaagccaagtcccttcgacggtctagaaagtnttggtacggtctaagttttataccgttggtactaaggtactaaattatttaatacttcccttaccttccctttccggtaccgggtaaccgtttccggacccggaaagggtaacccggtaggggtaaggtaaacttaccgaaaaccggaagttcggttaggacccgttaggaccctaaccgtaacgttccgttcggttaccccttttcgaaaccttttccccggtttccccccgagttaaccctttcggttaagtaaaccggg

SEQ ID NO: 403226 - DNA, 386 bp, Homo sapiens
  misc_feature: GZ8MTXP01C6AA7.13.11.A11.1.454.CMB.2.raw
  modified_base (381)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctatttattctgtcaccagtatggtaggtcaccgtacacttttggccaggggaccaagctggagatcaagcgaaactgtggctgcacatctgtcttccatcttcccgcatctgaatagtacgtgactgagcgggctggcaggcgcagtagnnnnnn

SEQ ID NO: 403227 - DNA, 640 bp, Homo sapiens
  misc_feature: GZ8MTXP01CYOUQ.13.11.A11.1.454.CMB.2.raw
  modified_base (191)..(191): a, c, t, g, unknown or other
  modified_base (213)..(213): a, c, t, g, unknown or other
  modified_base (217)..(217): a, c, t, g, unknown or other
  modified_base (474)..(474): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatcgtccgtcgtcccccgganagacagcctacatcactgctcngganatgtattgactaagagttatggttcctggtactcagcaggaacggcacgccacgccccctgtcctactctaacttctttaaacaaaactccgaggcccggtcccttgtccgggggtcctgacgctacttcgtccccggctccgcttacggacgggaaacctacgaagtccacgttcgacgaacctagtccgacggccgggaacccaggtaccttagtcgagtcggtacgcgttcgttaccttacttcgtacgtcggngggggtcggtacggggacaacggcgtcgtggtccgtcggggttcgggcgggacgggtacccgtggttcgtacgggttccgttacggttacggtccgaacgttcccgaacgggccctcccggggtcccctcgggtacctccgttccgttcccgttccctaaccccgg

SEQ ID NO: 403228 - DNA, 579 bp, Homo sapiens
  misc_feature: GZ8MTXP01APQYT.13.11.A11.1.454.CMB.2.raw
  modified_base (198)..(198): a, c, t, g, unknown or other
tcagtcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccgaggggaaanagcccaccctctcctgcagggccagtcagattgcagcagcaactacttagcctggtaccagcagaagcctggccacggcccccaggctcctcatctacgatgtatcaggagactactgacactcccagacaggtcaggtcggcgagtgggtcgtgggaacagcttcacctctccaccactcacgcagacctaggaacctgaaagtactttgtactattttattctgttacaaccgtagggttagtaggggttacgtaccgtaaccgttacgttcgttttacgggaccggtaacggggacccgtaaggccgttaggaagtaacttcgaaagcgaaacgttgcggttcttgccactaatcttacgttcctcttaacttccccg

SEQ ID NO: 403229 - DNA, 715 bp, Homo sapiens
  misc_feature: GZ8MTXP01AHN5U.13.11.A11.1.454.CMB.2.raw
  modified_base (267)..(267): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcactaatgttcggtccctatgactatatattggtaccgacaagaacgccgagggacgtcccncccctagtttctccgtgtacggttcaggtacaaactcaagaactaaacgacgagggctcgtaggaccgtccccgagccgtacttctcgtacggactaccgaaggtactcgtacttaaccgaacgcccgaaacggacgtaaggggtaacttacgtttaactctaacgttctcggtacgggccttacgacggttcacggagtagtacgggtacgtcttaggtacttttaagtttaaccggggtttgtttacggtacgtttacggacctaaaccgtaaacaacccggtccgttaggtacctttccggtaccgggacccgttaacgggaacccgttaccggggtccttaacccgggttcgtaaaccgggttcccaaacccgggaccccgtaaaccggaccccctaaaaccccgtcggtaccgttaccccgtaaccttcccgtttaacccccg

SEQ ID NO: 403230 - DNA, 694 bp, Homo sapiens
  misc_feature: GZ8MTXP01B2HUO.13.11.A11.1.454.CMB.2.raw
  modified_base (244)..(244): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgactatatattggtaccganagaacgcgagggactccctcccctagttcctctgagttcaggtacaaactcagaactaaacgacaggctcgtggacgtccccagcccgtcttcgtcgtggtaacctaccgaaagggtctacgtacttacccgaccgtaacggacgtaaaggggtacttaacttacctctaacttccgtcgtagggccctacgagttcctaggaacgagttcgggaacggtccttagtaaccttagtttacgttggggtttacgtacgttaggaccctaaaccgaacgtaaccggtccgttagggtaccttacccgggttacccgggaacccgttcgggggtaaaccccgtcgggttcccaaaccccgggttcgtaaaccggtaccgacccgttaccccgaaccggtaacccccaaacccgtcgttcgtaccttaccgtttcccgttcccggtttcccccg

SEQ ID NO: 403231 - DNA, 665 bp, Homo sapiens
  misc_feature: GZ8MTXP01AZ418.13.11.A11.1.454.CMB.2.raw
  modified_base (235)..(235): a, c, t, g, unknown or other
  modified_base (375)..(375): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcgtggtttctgtgctatttaaaggtgtcagtgtgaggtgcagctggtagagtcgtgggggaggtgtggtacggccgtgggggtccctnagctctcctgtgcaacctctggattcagtatttgatgagtatggcatacacgtgggtcccgaccaaccgtccgaggggaaggggctgcgtaggtgggtctcgtaggtaataaacgtggaactggtgcagcaaacaacttncgcagtacctgtaggtagaacgggccctattccaaccattccgtacccaaggaactaactaaacgttaccgaacgggtaaacccgtaccgtacgttacggggtaacgtaggggaacgtaacggtacgggaccggtaccgaggaaccgtaccgtacggaaccggacgaacggtaacttaacgttttacgtacgttcggtagggtacgggtttagggttttcgttgggttaaggttacgggtaacggttacgggtaaccgttaaaccgggttaaccggttcggggtaacccg

SEQ ID NO: 403232 - DNA, 657 bp, Homo sapiens
  misc_feature: GZ8MTXP01AG3JW.13.11.A11.1.454.CMB.2.raw
  modified_base (264)..(264): a, c, t, g, unknown or other
  modified_base (382)..(382): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcgtggtttctgtgctatttaaaggtgtcagtgtgaggtgcagctggtagagtcgtgggggagtgtggtacggccgtgggggtccctgagactctctgtgcaacctctggattcagtnttgatgagtatggctatacacgtcgggcccaccaaccgtcggaagggggaagggctgctagggtgggtctcgtaggtaataaagtggaatggtgacccgagcctaaaactaactttgngactagtactcgtagggtacggacggtcctaataccaactctaccgacgaagtaactaacctaaacgtacccgaaagggtaaccaccgtaccgttaacggggtaaccggtaggggtaacgtaacgggtccggggtacccgtcgtaggaaaccgtacccgtaggaacccgtaacgtacgttaactttaaatttcgtacggttggtacggtggttaggtttgcggttaaggtacgtaacggtacggaaaccgttaccgggtaacgttcggggtcccg

SEQ ID NO: 403233 - DNA, 571 bp, Homo sapiens
  misc_feature: GZ8MTXP01DXJ4K.13.11.A11.1.454.CMB.2.raw
  modified_base (190)..(190): a, c, t, g, unknown or other
  modified_base (360)..(360): a, c, t, g, unknown or other
  modified_base (417)..(417): a, c, t, g, unknown or other
  modified_base (444)..(444): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtcctactcatctttacaaaataccaggccgccctcgtcggggtccctgacgcgattcctccccggctccgcctctgggaaaccacngtcacgtctagaccatcgagccggacccaggcctattgaatgaggctgtctacttcngttcagggggtcgtggggactaaacgngcgtgccgtgggttccgggcggtaggggacccagggtcctggttacccgtcgtttacgggccacggcccgaagggcccttccggccccccgttgggtccaccgttccgttccgttcccccgtccccg

SEQ ID NO: 403234 - DNA, 392 bp, Homo sapiens
  misc_feature: GZ8MTXP01EPFT7.13.11.A11.1.454.CMB.2.raw
  modified_base (331)..(331): a, c, t, g, unknown or other
  modified_base (347)..(347): a, c, t, g, unknown or other
  modified_base (369)..(369): a, c, t, g, unknown or other
  modified_base (383)..(383): a, c, t, g, unknown or other
  modified_base (385)..(392): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcacatcagcagactggaacctgaagtactttgacttactttattctgtcacagtatggtagcacgtactacgtttggccgtagggaccaagcgtaggagatacgaagcgaactggtgctgcacatctgtctcntctcccgctatctcgntagtacgtgactgaggcgggtntcggacaaggcganannnnnnnn

SEQ ID NO: 403235 - DNA, 662 bp, Homo sapiens
  misc_feature: GZ8MTXP01A69WY.13.11.A11.1.454.CMB.2.raw
  modified_base (270)..(270): a, c, t, g, unknown or other
  modified_base (422)..(422): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggactcctccccagtttcncctgaggttcaggtcaaactcagaataaacgacgagggctctggaacgtccccagccgtcttctcgtggactccgaaaggctgtaacttcccgaccaacgcgaaggggtatacttactcaattcctcgtcgggctccaggtcctgaacggtntagagtctagtaacttagtttacgttggggtttacgtacgttacgacctaaacgtaaacgaccgtaccgttaggtaccttccggttaccgggtacccgtcgggtaacccgtaaccgggttcccgtaaacccgttccggtaaacgggtccgaaccggttaccccgaaacccgggtaaccccctaaaccccgtaaccgttcggtacccttacccgtttcccgtttccccggtttaacccccg

SEQ ID NO: 403236 - DNA, 655 bp, Homo sapiens
  misc_feature: GZ8MTXP01EZSF3.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatagttggtaccgacagaagccagggacgtcctcccagtttctcctggaggttcaggtcaaactcagaataaacgacagggctcgtggacgtccccgagccgcttctctcggatcgaaggatgaacttccgccaaacgcgagggattacgtttaactctaacttcctcgtcgggctccaagtcgttacgacgtagtggaacggtctcggtaacttagtttaaccgttgggtttttacgtacgtttcgggacctaaaccgtaaaccgtaaaccgccgttacgggtaactttcccgttaccgggtacccggtaacggggtacccgttaccgggtacccgttacccggtacccgttaacgggttccgaccgaccccgaaaccgggccccaacccctaacgtcggttacctcccgttccgtttcccccg

SEQ ID NO: 403237 - DNA, 714 bp, Homo sapiens
  misc_feature: GZ8MTXP01A57YJ.13.11.A11.1.454.CMB.2.raw
  modified_base (243)..(243): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggactcctccccagttctcctgaggttcaggtacaaactcagaataaacgacagggctcgtggacgtccccagccgtacttctctggactaccgaaggatgtacttcccggaccaacggaccgaaggggtattacgttactcattctacgtgggctccgagtctagacgagttcggagggtctgtaacttacgtttaacgttcgggttttaggaaccgttttgggacccttaaaccgaaacccgtaaccggtacccgttacggggtacctttacccgggtttaccggggtaaccccgttacgggggaaacccctacccgggggtttaccaaccccgggtttcccgttaaccggggttaccgaacccggttcccccggaaaacggggaaccccctaaaccccccggttaacttcccgggttaacccttacccggtttcccttccccggttttccccccccgg

SEQ ID NO: 403238 - DNA, 724 bp, Homo sapiens
  misc_feature: GZ8MTXP01CZAEP.13.11.A11.1.454.CMB.2.raw
  modified_base (256)..(256): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccatgttggtccctatgacatatattggtaccacagagccagggatcccncccagttctcctgagttcaggtcaaactcagataaacgacgagggctcgtggaccgttccccgagcccgtctttctcgtgggaccttcccgaaagggcttcggacttacccggaccaacggccgaaaggggtattaacttactacacttcctcgtcggggtcctccgagttcgttaggaacgtagttggaacgggcttacgtaactttaactttaaccgttggggtttttacgtacgtttacgggacctaaacctaaaccgaaaccgtccgttacgggtaacctttccggtttacccgggaacccggttcggggaaaccccgtaccgggttacccgtaaaccccgggttccccgttaaacggggttaccccaacgggttacccccgttaaaaccgggggtccccccaaaaaccccctccggttaaccgtcccgttaacccttccccgtttcccggtttaacccccccc

SEQ ID NO: 403239 - DNA, 386 bp, Homo sapiens
  misc_feature: GZ8MTXP01A6BRU.13.11.A11.1.454.CMB.2.raw
  modified_base (371)..(371): a, c, t, g, unknown or other
  modified_base (383)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtggtctgggacagacttcactctcaccatcagcagactggaacctgaaagactttgctacttttatttctgtcaccagtatggtaggtcaccgtacacgttttggcctaggggaccaagctggagatcaagcgaactgtggctgcaccatctgtcttccatcttcccgccatcctgaatagtacgtgactgagcgggcnggcaaggcgcannnn

SEQ ID NO: 403240 - DNA, 713 bp, Homo sapiens
  misc_feature: GZ8MTXP01BF7CD.13.11.A11.1.454.CMB.2.raw
  modified_base (242)..(242): a, c, t, g, unknown or other
  modified_base (257)..(257): a, c, t, g, unknown or other
  modified_base (284)..(284): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgactatatatggtaccanagagcagggactccncccagttctctgagtcaggtacaactnagaactaaacgcgagggctcgtggacctcccagccgtcttctcgtaggacctccgaaggatgacttacccgacctaagcgagggtatacgttacactactctgtcgggtctacccgtagtccttaggaaccgtagttcggaacgggtcttacgtaaacttagtttaccgttagggggttttcgaacgtttacgggaacctaaaccaaacccgtaacggtcccgttaagggtacttcccggttacccgggtaaccggtaccggggtaacccgtaaccgggttcccgtaaccccgggtttacccggaacgggttaacccgaaaccccgggccccggttaaaaccgggaaccccccctaaaacccccccgggtaactttcccgggtaccccttaacccgtttccccgggttttcccgggtttcccccccccg

SEQ ID NO: 403241 - DNA, 559 bp, Homo sapiens
  misc_feature: GZ8MTXP01EK7X9.13.11.A11.1.454.CMB.2.raw
  modified_base (428)..(428): a, c, t, g, unknown or other
  modified_base (534)..(534): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtcaaactcagataaacgcagggctctggacgtccccagccgcttctctggactccgaaaggatgacttacccgcaacgcaagggatacttactcatctctgggctcagtctgacgatgaggctgacttattactggggtttanacgtttggacaacaaaccaacgtccgtaggtactccgttacgggaccttggggaaccctacgggttcacccgttcgtacgggtcacgcccaaaggccccaaacccnctacgtccactcttccgttaacccc

SEQ ID NO: 403242 - DNA, 584 bp, Homo sapiens
  misc_feature: GZ8MTXP01CEYLA.13.11.A11.1.454.CMB.2.raw
  modified_base (239)..(239): a, c, t, g, unknown or other
  modified_base (257)..(257): a, c, t, g, unknown or other
  modified_base (290)..(290): a, c, t, g, unknown or other
  modified_base (414)..(414): a, c, t, g, unknown or other
  modified_base (555)..(555): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttggtcctatgacatatattggtaccanagaagccagggactcccncccctagtttctcctgaggttcaggtacaactnagaataaacgacgagggctcgtggacgtccccagccgtcgttctcgtaggactccgaaaggatgacttcccgaccaacgcgtaagggtattacttactctatctacgtgggcttccgagttacnggacgtatcgacggtctagtacttagtttacgttggggtttgacgttcggactaaccgaacaacgtcctggtacttcgtcggaccgtggggaaccctcgggttcctaccgcgtacggtccacgccaacggcccctaacccncgttcgcttaccgttcttccgttaacccc

SEQ ID NO: 403243 - DNA, 780 bp, Homo sapiens
  misc_feature: GZ8MTXP01AR4MQ.13.11.A11.1.454.CMB.2.raw
  modified_base (246)..(246): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaattgttcggtccctatgactatatattggtaccganagaagccgagggactccctcccctagtttcctccgtgtacggttcaggtacaaactcaagaactaaacgacgaggctcgtaggacgtccccgagccgtcttctcgtggacctaccgaaggtctacgacttacccgaccaacggcgaaggggtaattaacgtttacctctaacttccgtcgtacgggtcccttaccgtagttcccgtaggtaaccggaagttcggaacgggtccttacggtaaacttttagtttaaccggtttggggttttacggtaaacggttttacgggaaccctaaaaccgtaaaccgtaaaccggttcccggttaaggggtaaccgtttcccggtttacccgggggtaacccgttccgggggtaaaccccgttacccggggttacccgttaacccccggttcccggttaaacggggttacccgaaccccgggttacccgttaaaaccccggggccccctaaaacccccgtccgttacccggttaccttaaccctttcccgtttccccggtttaaccccccc

SEQ ID NO: 403244 - DNA, 640 bp, Homo sapiens
  misc_feature: GZ8MTXP01BKK0Z.13.11.A11.1.454.CMB.2.raw
  modified_base (213)..(213): a, c, t, g, unknown or other
  modified_base (225)..(225): a, c, t, g, unknown or other
  modified_base (605)..(605): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagttgttttanacagctaccganaataggaactacttagcttaggtaaccaacagaaaccaggacacgcctaccgtaagttactcttttacgtgggtccgttaccgtaaccccggggaacgttccccgggggtcccctacggacccgtattcgaggtcgggcgaggccgggtctggggacagtacctttcactctcaccaatcaagcacgtcccttacgaggctagaagagtgtggactagtttatacgtgtacagtactaattattatacttcctactcccgttccgtacgggtaccgttccggacccgtaaacgggaccgtaaggggtacgtaaacgtaaccgaaaccggtaacgtgggtacggcctacgccgtaacctattccggttcttccctttaacncttaacccgttccccgcttacgtcgttaacgtaag

SEQ ID NO: 403245 - DNA, 338 bp, Homo sapiens
  misc_feature: GZ8MTXP01BD5S1.13.11.A11.1.454.CMB.2.raw
  modified_base (332)..(338): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggaactgtggctgcacatctgtcttcatccttccgcatctgatagtacgtgactgagcggctcggcaaggcgcataagnnnnnnn

SEQ ID NO: 403246 - DNA, 621 bp, Homo sapiens
  misc_feature: GZ8MTXP01AVAVV.13.11.A11.1.454.CMB.2.raw
  modified_base (260)..(260): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggatcccncccctagtttctcctgaggttcaggtcaaactcagaataaacgacagggctcgtggacgtccccagccgtcttctctggactaccaaaggtatcggacttacccgacccgtaacggcgaaggggtaattacgttaacctctaattcctacgtcggggcctccgagtcctaggacgtatggacggctagtaccttatttacgtgggtttcgacgtttggacctaacaaaccgaacgtccgtacgggtactaccgtttccgggaacctcggggaaccctaccgggttctaaacccgttccgtaacggttccgacgcccgaacggccccaacccgtaactcgtccacttcgttcgtttaacccc

SEQ ID NO: 403247 - DNA, 623 bp, Homo sapiens
  misc_feature: GZ8MTXP01A05GS.13.11.A11.1.454.CMB.2.raw
  modified_base (237)..(237): a, c, t, g, unknown or other
  modified_base (252)..(252): a, c, t, g, unknown or other
  modified_base (331)..(331): a, c, t, g, unknown or other
  modified_base (377)..(377): a, c, t, g, unknown or other
  modified_base (597)..(597): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgttcgtcctatgacatatattggaccanagagcgaggactccncccagttctctgtaggttcaggtacaaactcgaagaactaaacgcgagggctcgtaggaccgtcccgagtccgtcttcncgtcggactccgaagctacgactcccgacaagcaaggatacgtacnctatctgtcggctcagtcgtagacgtatcggacggtctacgtactttagtttacgttacggtttacggaacgtttcggaacctaaccgtaaacgtaaccgtccgttaagggtaaccttccggttaacccgggaccgtcggggaaaccctcgggttactacccgttacggtaccgggtacacccggacccaaaccgggaacccctaaccccgtggttaccnccttaccttccgttcccgttcccccg

SEQ ID NO: 403248 - DNA, 687 bp, Homo sapiens
  misc_feature: GZ8MTXP01DYFMI.13.11.A11.1.454.CMB.2.raw
  modified_base (241)..(241): a, c, t, g, unknown or other
  modified_base (256)..(256): a, c, t, g, unknown or other
  modified_base (265)..(265): a, c, t, g, unknown or other
  modified_base (271)..(271): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgttcttccctctctgcttctcctggagcgtcagccagtctcactgcacctgcgcagtgacactagtgtcgtcctatgactatatagtcgaacganagacgcgaggctccncctagttcncgtagngtcagtacaaactgaagaataacgacgaggtctcgtggacgtccccgagtcccgtcttcgtcgtacggaacctacgaaagggtatacggtaaaccgttcccgaaccgtaaaccgggtacggtaaacggggtaactttaaacttaccgtacgtacttccgttacggtggtccttaccgtagtaccgtagtacgacgttagggaccggtctaaggttactttaagtttaccggttaggtttacgtacggttacggaaccttaaaccgaaacgtaccggtcgtacgggtactttaccggttccgggaacgtaacgggaacccgttcggtaccgttacccgtacggtacgttaccgacccggttacccgaacggtacccctaaccccgtgttcccgttactaaccgtttcccggtccccg

SEQ ID NO: 403249 - DNA, 677 bp, Homo sapiens
  misc_feature: GZ8MTXP01BIGBH.13.11.A11.1.454.CMB.2.raw
  modified_base (331)..(331): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggaccacagagccagggactcctcccagttctcctgaggttcaggtacaaactcgagaataaacgcagggctcgtggactccccgagtccgtcttctcncggtactccgaaaggtctacgtacttcccgacctaacgcgaagggtatacttactacacttctcgtggcctcgagtctagacgtatcggagtctagtactaactttcgtgggtttagacgtttcggacctaaacaaaccgaaccgtccgtacggtacttccgttaccgggtaacccgttcggggtaaccccgtaaccgggttcccgtaaaccccgggttccccgtaaacggggttcccgaaacccggttcccccggaaaaccggggtaaccccccaaaacccccccggtaacttcccgggtaccccttaacccgttccccgtttaaccccggtttcccccccccgg

SEQ ID NO: 403250 - DNA, 642 bp, Homo sapiens
  misc_feature: GZ8MTXP01BBF4H.13.11.A11.1.454.CMB.2.raw
  modified_base (173)..(173): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcacgccaccctnagtcgtccgtcgtccccaggacagacagccagcactcaccgtgctacgtaaggaaataagtggacaagtaataaattactacttccgtaggtatcagacagaacgtcgacgcgtacgtccccgtgtcgctggtcattcgtatacgaagatcgacctaacggccgacccgtagacggactcccccgtagtacgcgtattccgtcgttacggcctacctaacgtcgtacgggtacctcgacgtccactctacgactacgtcgacggacccggacgacggtactaggtgagtacggtacgtcggtaagtacgttagttaccgtggtaccacggggtcgtacggggactacgacgtaacgccgaacgtccggcccggtacttcggttaccgttccggttacgggttacccggttacggtaacccgtacggtccgtaaccccgtacgttaacggtcccgaacccggtaaccccg

SEQ ID NO: 403251 - DNA, 426 bp, Homo sapiens
  misc_feature: GZ8MTXP01CPRHT.13.11.A11.1.454.CMB.2.raw
  modified_base (414)..(426): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactacgtttcggccgtaggggaccaaggctagggagatacgaaagcgtaaacgtggtaggctagccaccattctgtcttccactcttcccgcctatcctgaatagtacgtgacgtggacggcgggctgggacgaaggcgactagagnnnnnnnnnnnnn

SEQ ID NO: 403252 - DNA, 404 bp, Homo sapiens
  misc_feature: GZ8MTXP01AJ3LE.13.11.A11.1.454.CMB.2.raw
  modified_base (241)..(241): a, c, t, g, unknown or other
  modified_base (351)..(351): a, c, t, g, unknown or other
  modified_base (388)..(388): a, c, t, g, unknown or other
  modified_base (393)..(404): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagtctttgctacttttattcngtcaccagtatggtaggcaccgtactacgtttggccgagggaccaagctggagatcaagcgaactggtggctgacaccgatctgtcttccatccttacccgctatctagntagtaccgtgactggacgcgggtcaggcaaggtccanatagnnnnnnnnnnnn

SEQ ID NO: 403253 - DNA, 714 bp, Homo sapiens
  misc_feature: GZ8MTXP01CZXLW.13.11.A11.1.454.CMB.2.raw
  modified_base (264)..(264): a, c, t, g, unknown or other
  modified_base (277)..(277): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctacctgcgcagtggcacctaatgttcggtccctatgacatatattcggtaccacagaacgcgagggactcccncccctagtttccnccgtggtagttcaacggtacaaactcgaagaactaaaacgacgagggtctcgtggaccgtccccgagtcccgtcttcgtcgtaggtaccctaccgaaagggtactcggtaacttaccccgaaccgaaccggccgtaaaggggtaaacttacttactactactccgttcgtgggcctcgtaaggttctaggaacgtagttcggacgggtctagtaacctttagtttaacgttgggttttacgtacgtttaggaccctaaacaaacccgtaacgtccgttaagggtaccttccggtttaccggaccggttccgggaaacccgtacgggttcccgtaaacccggttccgttaacgggtacccacccggacccgaaacccgggtaaccccaaaaccccgttcgtaccgtacccgaccgttcccgttaacccgttaaccccc

SEQ ID NO: 403254 - DNA, 845 bp, Homo sapiens
  misc_feature: GZ8MTXP01BW1QO.13.11.A11.1.454.CMB.2.raw
  modified_base (218)..(218): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctgganatgtatgactaagagtatgtctggtatcagcagagcaggccacgcccctgtcctactcatcttacaaactccgaggccgccctcgtcggggtcctagacgcgtactccgtccccggcctccggcccttacgtacggggaaaaccacgtaacggtccacttcctacgacctagtaccgacgggtacccgggaacccacggtcccttaagtttacggacgttacgggtaacggggtccctttacgggttacccttacgttacccgttgggttacccggtaacggggggtacggggtttaaccggggggaaacccttaaaacccgggacggggtttcccgggtacgggtttcccgggtttcgggggttttacccggggggaacccggggggttaaaccgggggtaaccccgttaacgggggtttaaccccgttacccgggggtttaaaccccgggttttccgggttttaacccggggtaacccgggtaaccccgggacccccgggttaaaacggggttccccccgggttaaaccccgggtccccccccgggtttcccgggtttaaccccgtaccccgttttacccccgggttcccccgggggtttttccccccctttaaccccccccggg

SEQ ID NO: 403255 - DNA, 552 bp, Homo sapiens
  misc_feature: GZ8MTXP01BBUQ2.13.11.A11.1.454.CMB.2.raw
  modified_base (242)..(242): a, c, t, g, unknown or other
  modified_base (261)..(261): a, c, t, g, unknown or other
  modified_base (347)..(347): a, c, t, g, unknown or other
  modified_base (480)..(480): a, c, t, g, unknown or other
  modified_base (525)..(525): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccanagaagccgagggagtcccnccccagtttctccgtgaggttcaggtcaactcagataaacgacagggctcgtggacgtccccagccgcttctctggactccaaggntgacttccgacaacgcagggatattactcatctcgtgggctcgagtctgacgatgagctgacttattacgttggtttgtacgtttgactaacaacgaacgccgtaggactcgttaccggaccgtgggaacccncggttcacccgttcgtacggtccacgcccgacggccccaaccccnctcgtcacctccgttccgttaaccccc

SEQ ID NO: 403256 - DNA, 391 bp, Homo sapiens
  misc_feature: GZ8MTXP01BXSDT.13.11.A11.1.454.CMB.2.raw
  modified_base (256)..(256): a, c, t, g, unknown or other
  modified_base (320)..(320): a, c, t, g, unknown or other
  modified_base (379)..(379): a, c, t, g, unknown or other
  modified_base (385)..(391): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagtattttgctagtatattcctgtcactagtttgngactcaacggtggacgtcggcagtgggaccaaggtgaaatgaaacgatgtggctgcaccatctntcttcattccttccgcatccctgatagtacgtgaactgcggcgggctgggacaaggcgngaatgnnnnnnn

SEQ ID NO: 403257 - DNA, 771 bp, Homo sapiens
  misc_feature: GZ8MTXP01DOANG.13.11.A11.1.454.CMB.2.raw
  modified_base (247)..(247): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgttcttccctctctgcttctcctggagcgtcagccagtctcacctgccaccttgcgcagtggcaccaatgttcggtccctatgactatatattggtaccanagaagcgagggatccctccctagtttctcctgaggttcaggtcaaactcaagataaacgacgagggactcgtggacgtccccgagcccgtcttctcgtacggactaccgaaaggactacgaaccttcccggaacccgaaacggtccgaaacggggtaacttaactttactactagttacccttacggttcggggtccctaccgtaggttaccttaggacgtaagttggaacgggtactggtaactttactttaacgggttggttttacgaaaccgtttcgggaaccaaacccgtaaaccgtaaccggtcccgttaggggtaacctttaccggttcccggggtaaacccggttaaccgggggtaaaccccgttacccgggggttaccccttaaaccccggggtttaccccgttaacggggtttaccccgaacccgggaaccccccgtaaaaaccggggaccccctaaaaccccccgtaacggttcccggttaacccttaaccccgtttccccggtttaacccccg

SEQ ID NO: 403258 - DNA, 634 bp, Homo sapiens
  misc_feature: GZ8MTXP01BTOYU.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacccgcaccttgcgcagtggcacctaatgttcggtcctatgactatatattggtaccgacagaagccgagggacgtccctcccagttctccgtgacgttcaggtactaaactcgaagaacgtaaacgacgagggtctcgtacgggacgtcccccgagtccgtcttctcgtggactaccccgaaggtatacgtactcccgaacctaaacggcgtagggtaacttaacttacctactacttcgtcgtacgggcctaccgtagtctagacgatacgggacgtctagaacttatttacgtggtttcgacgtttggacctaaacgaacgtaccgtcgtggtaaccttcgtaccgggacctcgggacccaacggtccaccgtcgttaggacccacgaccccgaacgcccctaaaccctcgtcgtaccctcgttcccttcccggttcccctccccg

SEQ ID NO: 403259 - DNA, 382 bp, Homo sapiens
  misc_feature: GZ8MTXP01BYV7O.13.11.A11.1.454.CMB.2.raw
  modified_base (339)..(339): a, c, t, g, unknown or other
  modified_base (341)..(341): a, c, t, g, unknown or other
  modified_base (376)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaatctttgctacttttattctgtcaccagtatggtagtcacgtactactttggccgagggaccaagcgtggagatcaagcgaactgtggctgcacatctgtcttcatcttcccgcatcngntagtacgtgactgagcgggctggcaggcgcatagnnnnnnn

SEQ ID NO: 403260 - DNA, 569 bp, Homo sapiens
  misc_feature: GZ8MTXP01CMAIV.13.11.A11.1.454.CMB.2.raw
  modified_base (349)..(349): a, c, t, g, unknown or other
  modified_base (376)..(376): a, c, t, g, unknown or other
  modified_base (543)..(543): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtccctccccagtttctcctgaggttcaggtcaaactcagataaacgacagggctctggacgtcccccagcccgctttctctggactaccaaggntgacttccgccaacgcagggatatacncatctctgggctccagtcctgacatgagctagactattactggtttcgactttggacctaacaacgtaacgccgtagggtactacgttcggaccgttggggaaccctacgggttcctaacccggttccgtaaacgggtcgaccgccccgaacgggccccaaaccccngttctcaccttcgttcgtttcccccg

SEQ ID NO: 403261 - DNA, 582 bp, Homo sapiens
  misc_feature: GZ8MTXP01EHSAI.13.11.A11.1.454.CMB.2.raw
  modified_base (238)..(238): a, c, t, g, unknown or other
  modified_base (256)..(256): a, c, t, g, unknown or other
  modified_base (383)..(383): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgtgtcctatgacatatattggtaccganagaagccagggagtcccnccccagttctcctgaggttcaggtcaactcagataaacgacaggctcgtggacgtcccagccgtcttctcgtggactccgaagatgactaccgccaacgcagggatagttactcatctcgtggctcngtcgtgaacgatgaggctgacttattacttgggtttagtacgtttggacaacgtaaccaacgtcccgtaggtaactccgttaccggtaccgtcgggaacccgtcggttaccgtacccggttccgtaacgggtccgacgccccgaacgggccccaaaccccgtaactccggtaccaccttccgttcccggtttccccccg

SEQ ID NO: 403262 - DNA, 534 bp, Homo sapiens
  misc_feature: GZ8MTXP01BXH5Y.13.11.A11.1.454.CMB.2.raw
  modified_base (344)..(344): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtcctccccagtttctcctgaggttcaggtcaactcagataaacgacagggctcgtggacgtccccagccgcttctctggactccgaagntgacttccgaccaacgcagggatatactcatctcgtggctcgagtctagacgtagtgaggctgactagttactggtttgacgtttggactaacaacaacgtccgtaggacttcgttcggactgtcgggaccacggtcaccgtcgtaggttccagcccaaggcccaacccactgcctaacgttcgttcccg

SEQ ID NO: 403263 - DNA, 784 bp, Homo sapiens
  misc_feature: GZ8MTXP01BKSBS.13.11.A11.1.454.CMB.2.raw
  modified_base (245)..(245): a, c, t, g, unknown or other
  modified_base (420)..(420): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcttgggttttccttgttgcttaattttaaaaggtgtccagtgtgaggtgcagctggtagagtcgtgggggaggtgtggtacggccgtgggggtccctnagactctcctgtgccaaccttcgtggtattcagtatttgatgagttatggcataccgacgtcgggtcccaccaaccgtccggaagggggaacgggctggacgtagggtcggttctcgttaggttaaataaacgtggaaacgtgggtacgaccgaagaccaaaacctaaactttgngacaggtaccttcgtaggtagggaaacgggtccctaattaccccaactattccgaccgaaaggacgaacgtacggtccgaacccgtaacgtaaacccgttccccgtaaataacgtttccgaacggaaaccttaaaagtacggaaacccgtaggttaccccggttaacgggaaagggttaccccggaaacggggtaaccccgttaaacggggttaccccgttttttgggttaaaccgtttttccggtaggggttaccccgggttacgggttaaagggggtttttacgaacccggtttaaggggttcgggtttcccgttaacggggtttaaaccccgtttaacggaacccggttttaaaacggggg

SEQ ID NO: 403264 - DNA, 413 bp, Homo sapiens
  misc_feature: GZ8MTXP01EA4B6.13.11.A11.1.454.CMB.2.raw
  modified_base (293)..(293): a, c, t, g, unknown or other
  modified_base (405)..(413): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctatttattctgtcaccagtatggtagcacgtactacgtttggccgaggggaccaagctgganatcaagtcgaaactgtgctgcactatctgtacttccacttccttcccgctacttcctagtaattacgtacgtgacgtggacggtcgggtctgggacgtaagggcacagtagnnnnnnnnn

SEQ ID NO: 403265 - DNA, 694 bp, Homo sapiens
  misc_feature: GZ8MTXP01BXO8A.13.11.A11.1.454.CMB.2.raw
  modified_base (216)..(216): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctcgtgggcgagacgggccaccatcaactgacaagaccagccagagttgttttanacagcctaccgacaataggaactactagtcttacggaccaaacacgaaaccaggacagcctaccgtaagttactcttttacgcgggcgtccgtacccgggagtccccggggtcctcgacgtattcgagtggcaggtcggtctaggggactagtactttcactcactaccaatccaagcacgtcccttcgacgggtctagaaagtcgttggtacgggtacttaaggttttaacttacgttaggtaccagtactaaattatttaactacttcctacctttcccgttacccggtacgggtaccgtttaccgggacccggtaaaggggtacccggtaagggggttaaccgaaaacgttaacccaaaacgggtcgttaacgggttggaccgttccggacctaaaccgttaacttcggtttcgttcccctttaacgacctttccccttccccggtacccttaatttcgttaaccggtttaaacg

SEQ ID NO: 403266 - DNA, 630 bp, Homo sapiens
  misc_feature: GZ8MTXP01C5GCY.13.11.A11.1.454.CMB.2.raw
  modified_base (257)..(257): a, c, t, g, unknown or other
  modified_base (357)..(357): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgcctatgacatatattggtaccacagagccgagggacgtccnccctagttcctcctgaggttcaggtacaaactcaagaactaaacgacgacgggctacgtcggacgtccccacgccgtcttctcgtggactaccgaaggtntagacttacccgaccaacggcgaagggtacttacttactcaacttctcgtggtcctccgagtctagacgagtgaggctgtaacttattacgttgggtttacgtacgttacggacaaactaaccgaaccgtccgtagggtaacttccgttccgggaacccgttcggggaacccgaccggttaccgtacccggttaccgtacgggtaccaccggaccccaaccggccccaaaccccgtaactcgtacccttaccttccgttcccggtttcccccg

SEQ ID NO: 403267 - DNA, 721 bp, Homo sapiens
  misc_feature: GZ8MTXP01DK0E0.13.11.A11.1.454.CMB.2.raw
  modified_base (234)..(234): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctactaggaaataatggacanaataaatatacttctggtatcagacagaagtcaggccatccccgtgtgctggtcatctatacaagctcgaccaaggccggccctacgaggtctcccccgtgacgtcgtacttcctcgtcggccctacccgtaacttcggtacgggtaaacctcgaaccgcccctaactcgtacgaacccagtaccgacgggaccccgggtaacccgaacggtccgtaagtacgggtaattcgggacggttaccgttagttaaaccgtttaacgtttaaacgtcgggttaccgaacggggtccggggttaacggggaactaaacggacccgaaaccggtccgtaacccgttccgggcccccgggttagtttacggtttaccgggtttacccgtttaacccgggggttaaccgttacccgggggaaacccgtaaaacggggttcccgtaaacccgggttacccaacgggttaaccccgaacccggtaaaaccccccggg

SEQ ID NO: 403268 - DNA, 829 bp, Homo sapiens
  misc_feature: GZ8MTXP01DXQ40.13.11.A11.1.454.CMB.2.raw
  modified_base (200)..(200): a, c, t, g, unknown or other
  modified_base (219)..(219): a, c, t, g, unknown or other
  modified_base (239)..(239): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcncagtgcacatgtgtcctangacatatattacggtaccanagagcgagggactccctcccagttcctcgtagtacggttcaaggtacaaactcaagtaactaaacgacgacgggtcttcgtaggaccgtaccccaggtcccgtcttccgtcgtacgggtacctaccgaagggtctacgtaccttacccgaaccaacgggacgtaagggtacttaactttaccactactttccgcgttcgggtacttcccgaagttccgtaggtaaccgtagttacgggaaacgggttctaacggttaaccctttaaagttttccggtttaggggtttttaaccgggtaaccgtttccgggtaaaaccaaaccgttaaaacccggaaccggtaccggtttaacgggtaccgtttcccgggtttaacccgggtaaaccccggggttcggggtaaacccccggttaacggggttaccccgttaaaccccgggttcccggttaaacccgggggttcccggaaaaccccggttacccccgggaaaaaccccgggttccccccaaaaaaccccccggtttcgttaccccggggttacccgttaacccccgttttcccctttccccccgggttttaaaccccccccc

SEQ ID NO: 403269 - DNA, 586 bp, Homo sapiens
  misc_feature: GZ8MTXP01ARS4B.13.11.A11.1.454.CMB.2.raw
  modified_base (243)..(243): a, c, t, g, unknown or other
  modified_base (262)..(262): a, c, t, g, unknown or other
  modified_base (352)..(352): a, c, t, g, unknown or other
  modified_base (409)..(409): a, c, t, g, unknown or other
  modified_base (555)..(555): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggacgtccnccccagtttctcctgaggttcaggtacaaactcagaataaacgacagggctcgtggacgtccccgagccgcttctcgtgactccgaaggntgacttcccgccaacgcgagggtatacttactcatctcgtggctcagtctgaacgtntggaggtctgaacttatttactgggtttagtacgttggacctaaacgaacgaaccgtccgttaggtacttccggttacggaccgttggggaaccctacgggttccaccgttccgtacggtccacgcccgaacggaaccccaacccncgtacgccttacttccgttccgttaaccccc

SEQ ID NO: 403270 - DNA, 604 bp, Homo sapiens
  misc_feature: GZ8MTXP01EKMP7.13.11.A11.1.454.CMB.2.raw
  modified_base (240)..(240): a, c, t, g, unknown or other
  modified_base (255)..(255): a, c, t, g, unknown or other
  modified_base (266)..(266): a, c, t, g, unknown or other
  modified_base (284)..(284): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcgcagtgcacaatgttcgtcctatgactatatattggaccanagagcgaggactccnccctagttccnctgagttcagtacaactnagaataaacgacgaggtctcgtggaccgtcccagccgtcttcgtcgtggacctaccgaaggtctacgtacttacccgaccaacgcgaagggtattactactctatcctagtcggctccgagtctagaacgtgtggacggcttagtaacttaattcgttggggtttacgtaacgttacgaccaaacgaaacctacggtccgtagggtacttcggttaccggaccgtgggaaccctaccgggttcaacccgttcccgtaggtaccgaacggcccaaccggaacccaaccctaagtcgcccttacttccgttaaccgtccccc

SEQ ID NO: 403271 - DNA, 719 bp, Homo sapiens
  misc_feature: GZ8MTXP01B6E3P.13.11.A11.1.454.CMB.2.raw
  modified_base (236)..(236): a, c, t, g, unknown or other
  modified_base (252)..(252): a, c, t, g, unknown or other
  modified_base (692)..(692): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtgcactaatgttgtcctatgacatatatggtacanagagcgaggactcccncctagttctcgtagacgtcgaggtacaaactcgaagaacgtaaacgacgacgggtctacggtcggaacccgttccccgaacggtccccgtacctttaccgtacggtacggtaacccgtaacccggtaaagggtaacgttccggtaacccgtttaaccccgggaaacccgtaaccggaccgggtaaaagggggtaactttaaaccgtttaacctacggtaactttacccgttacggtcgggtacctaccgtacggttaccgtaggaaaccggtagtacggtacggtacttacggtaaaccttagtttaacgtttggggttacgtacgttacgaccaaacgtaaccgaccgtccgtaagtcgtccgttccggaccgtcggaacccgtacgttccgaccgttcgtacggtcaccggacccgaacgtccccacccgtaacgtcncccgttacttccttcccgttaaccccc

SEQ ID NO: 403272 - DNA, 686 bp, Homo sapiens
  misc_feature: GZ8MTXP01EUHGD.13.11.A11.1.454.CMB.2.raw
  modified_base (244)..(244): a, c, t, g, unknown or other
  modified_base (658)..(658): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatagttaggtaccanagaagccgagggacgtccctcccctagtttcctcctagtacggttacacggtaacaaacgtctaaagaactaaaacggacgaggggtactccgtagggacccgtccccgaacggtcccgtccgtttccgtacgttacggggaaccttacccggaaaggtacgtacgtaaccggtttaccccggaacccgaacggaccgtaaaggggtaactttaacgttaacctcgtaacttcccgtacggtacgggtcctacccgtaagtccgtaggaaacgtgttacggacggtctacgtaacgtttagttacgttggtttagtacgttaggactaaccaaacgacgtccgtagactcgtacggtaccgtcggaactcggttacaccggttacgtagggtcacgccgaacggtcccaacccncgttcgcttacctcgttccgttaacccc

SEQ ID NO: 403273 - DNA, 885 bp, Homo sapiens
  misc_feature: GZ8MTXP01CGVXL.13.11.A11.1.454.CMB.2.raw
  modified_base (190)..(190): a, c, t, g, unknown or other
  modified_base (218)..(218): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccacctccatcgtccgtcgtccccgganagacagcctacatcacctgctcgtgganatgtatgactaacgagtattggttctggtatcagcagaagcaggccacgccccctgtccctactctattcctttaacaaaactcccgagggcccgtccccttacgggtcggggtccctaggacgtccgtacttccgtccccccgggccttccggtcccgttacggtacggggaaaaccctacccgtaaggtccctaaccgttccgtacgaaccctaacgtcccggaacgggacccgggtaaccccgtacgtacccgtttaagttccggaaagttcggggtaaccgttccgtttaccgggttaccctttaaccgtttccggttacggggttaccccgggaacgggggggggttacccggggttaaccgggggtaaaccccaaaaccgggtacggggttcccggttcggggttacccggttttacccggggggtttaccgggggtaaccggggggaaacccggggtaccccgttaacgggttccccggttaaccgggttaaccccgggttttaccgggttttaaccggggaccccgttaaaccgggaccccccggttaaacgggggttcccccgtttcccccggggtcccccccggtttaacccggggttcccttaaccccggttttccccgtttaaccccggtttcccccccccgtttaaccccccgg

SEQ ID NO: 403274 - DNA, 660 bp, Homo sapiens
  misc_feature: GZ8MTXP01ESPNP.13.11.A11.1.454.CMB.2.raw
  modified_base (243)..(243): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggactccctccccagttctcctgaggttcaggtacaactcagaataaacgacagggctcgtaggaccgtccccagccgtcttcgtccgtggactaccgaaaggtatcgtaacttaccccgacctaacggcgaaaggggtacttaacttaccgtcacttcctcgtcgggcctccgagtccgttagaacgtagttggacggtctagtaacttagtttacgttgggtttcgaacgtttggacctaaacgaaaccgtacggtccgttagggacttccgttaccgggaccgttcgggggaaccctaccgggttacctacccggttccgttaacggggtccaaccggttccccgaaacggccccaaacccccgtcgttacgtacccttactttcccgttccgttaaccccccc

SEQ ID NO: 403275 - DNA, 405 bp, Homo sapiens
  misc_feature: GZ8MTXP01DP7UG.13.11.A11.1.454.CMB.2.raw
  modified_base (359)..(359): a, c, t, g, unknown or other
  modified_base (392)..(392): a, c, t, g, unknown or other
  modified_base (399)..(405): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaaacctgaaagtctttgctacttttattctgtcacagtatggtagtcacgtactacgtttggccaggggaccaagcgtaggagatacgaagcgtaaacgtgtggctggcacctatctgtcttccacttcttcccgctagtctagntagtacgtgactgaggcgggtctggacaaggcncgatagnnnnnnn

SEQ ID NO: 403276 - DNA, 422 bp, Homo sapiens
  misc_feature: GZ8MTXP01EHRIM.13.11.A11.1.454.CMB.2.raw
  modified_base (411)..(411): a, c, t, g, unknown or other
  modified_base (413)..(413): a, c, t, g, unknown or other
  modified_base (415)..(422): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcaggtgggtctgggacagacttcactctcaccatcagcagactggaacctgaagtctttgcttaattttattctgtcaccagtagtggtaggtcacgtactacgtttggccgaggggacccaaggcgtaggagactacaagcgaacgtggtggctgcaccatctgttcttccacttccttcccgcctatcctagtaacttacgtacgtgtaccgtgggacggcgggtgtacgcgaaggcganangnnnnnnnn

SEQ ID NO: 403277 - DNA, 617 bp, Homo sapiens
  misc_feature: GZ8MTXP01DF0JD.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccgacagaagccagggatccctccccagtttctcctgaggttcaggtacaaactcagataaacgacagggctctggacgtccccagccgcttctcgtggactccgaaggatgacttcccgaccaacgcgaaggggtattaacgttactcgactcgtctgggcctcagtctgacgatgaggctgtacttattacgtgggtttacgacgtttggacctaacgaaaccaaccggtcccgttagggactttccgttaccgggaccgttcggggaaccctacggggttcctacccggttccgtaacgggtccaacggccccgaaaccgggtccccaaacccccgtcgttcggtaccaacccttccgttcccggtttaaccccccc

SEQ ID NO: 403278 - DNA, 662 bp, Homo sapiens
  misc_feature: GZ8MTXP01BD4BY.13.11.A11.1.454.CMB.2.raw
  modified_base (265)..(265): a, c, t, g, unknown or other
  modified_base (285)..(285): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcactgcaccttgcgcagtggcacaagtgttggtcctatgacatatattggaccacagaagcgaggactcctccctagttcnctgtagttcaggtacaactnagtaactaaacgacgaggtctcgtaggaccgtcccgagtccgtcttcgtcgtaggtacctaccgaaaggtatacgtacttaacccgaaccaacggtacgaaagggtaacttaacgtttaacctcgtaaacttcccgtacggtcggggtacccttacccgaggtttaccgtaggaaccggtaagttggaaacgggtccttagtaaacctttagtttaaccgttggggttactacgttacggactaacaaccgacgtccgtaggtactcgttaccggacgtcgggaacccgtaacgttccgaacccgttcgacggacgaccgacccgaacggaacccctaaaccgtcggttcaccgttacctccgttccggttcccccg

SEQ ID NO: 403279 - DNA, 559 bp, Homo sapiens
  misc_feature: GZ8MTXP01A0U3Y.13.11.A11.1.454.CMB.2.raw
  modified_base (286)..(286): a, c, t, g, unknown or other
  modified_base (296)..(296): a, c, t, g, unknown or other
  modified_base (469)..(469): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccacgtcccctgtgctggtcntctatcaagntcgccaagccggcctcgagggactcccccgtgacgcgtattcgctggctacctaacgtctagggacctcacgccctactctacgaccatccgaggcccggggaccccagggtcctaggtcggagttggacgggtctaggtaccttagttaccgtgtcgagggtcggagggacngcgcgcgaacgtccgacctcgttagtcgtacgttacgggacgttcgggaaccgtacgttccacggtccgttaacgtccaacggaaccccg

SEQ ID NO: 403280 - DNA, 424 bp, Homo sapiens
  misc_feature: GZ8MTXP01A56HV.13.11.A11.1.454.CMB.2.raw
  modified_base (415)..(424): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtcttgctacttttattctgtcacctagtatggtagtcaccgtactacgtttcggccgagggaccagctggagatacaagcgaactggtaggctgcacgtatctgtcttcctacttccttcccgcctattcctagtaattacgtacgtagtaccgtggacgggcgggtcgtgggacgaaggcgactagtagnnnnnnnnnn

SEQ ID NO: 403281 - DNA, 648 bp, Homo sapiens
  misc_feature: GZ8MTXP01AD0AL.13.11.A11.1.454.CMB.2.raw
  modified_base (260)..(260): a, c, t, g, unknown or other
  modified_base (271)..(271): a, c, t, g, unknown or other
  modified_base (350)..(350): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccacagacgcaggacgtcccnccccagtttcncctgacggttcaggtcaaactcagataaacgacaggctcgtggactccccgagccgtcgttctcgtggactccgaaggntcgacttacccgcaacgccgaagggattacgttactcacttcctcgtggctccgagtcgtgacgatgacggcttagaacttattacgttgggtttagacgtttgggacctaaacgaacccgtaaacgtcccgttagggtacttcccgggtttaccggaccccggttggggaaacccctaacgggttcccgaaaccccggttcgtaacggggttacccaaccggccccgaaacgggttaacccccaaacccctcgttaccggtcccttaacctttcccgttaaccgggtttcccccccg

SEQ ID NO: 403282 - DNA, 393 bp, Homo sapiens
  misc_feature: GZ8MTXP01EZQRO.13.11.A11.1.454.CMB.2.raw
  modified_base (388)..(393): a, c, t, g, unknown or other
tcagtcacgtactacacgaccggtgctcgatttagctacgactgcagggccagtcagattgtcagcagcaactacttagcctggtaccagcagaagcctggccacggcccccaggcctcctcatctacgatgtattcaggaggaccactgacatcccagacaggttcagtggcaggtgggtctgggacagacttcactctcaccatcagcagactggaacctgaagtctttgctatttattctgtcactagtatggtaggtcaccgtactacttttggcctaggggaccaagcgtggagatcgaagcgaactgtggctgcacatctgtcttcatctcccgccatctgaattagtacgtgactgacggcgggctggcaaggcgcatagnnnnnn

SEQ ID NO: 403283 - DNA, 704 bp, Homo sapiens
  misc_feature: GZ8MTXP01DWBSY.13.11.A11.1.454.CMB.2.raw
  modified_base (194)..(194): a, c, t, g, unknown or other
  modified_base (347)..(347): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctctatgagttgactcacgccaccctcagttcgtcccgtcgtcccccgganagacagcctacatcacctgctcgtggatatgtattcgaactaacgagtacttcggttcctggtatcgagacgaggaacggcacggccaccgtcccctgtcctactctacttacttaacaaactccgacggtccgtacctcggtcggggtcccnggaccgtacgctttcccggtccccggcctaccggccgtcgtaacgggaacctactcggtccactcacggaccagtacgaccggaccggtacctaagtccttaagttcgagtagggtacgtcgtttcgttaccttacgttcgtacgtaccggtaggggggtcgtacgggaaccaaacggtcgggtcgtcggtacgttcggggtcgggaccgggaacggtccgttaggtaaccggttcggttacccgggtttcttaaacggggcccgtacccggacccggttacgggttccccttcccgggggtcccccttaacgggttcctacccgtttcccgttccccggttcccctttaacccccg

SEQ ID NO: 403284 - DNA, 612 bp, Homo sapiens
  misc_feature: GZ8MTXP01DU8OO.13.11.A11.1.454.CMB.2.raw
  modified_base (193)..(193): a, c, t, g, unknown or other
  modified_base (222)..(222): a, c, t, g, unknown or other
  modified_base (493)..(493): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccacccctcatcgtcccgtcgtcccccgganagacagcctacatccacctgctctggagntgtatgactaacgagtatggttctggtatcagcagaagcacggccacgccccctgtcctactcattctttacaaaactccaggccggccctcggtcggggtcccctggacgtcgtacttcccgtccccggccttcccgcctcggtacgggaaaacccacgtcgtctactcctacgacccatcgacggccggaccagtcctatgagtgagtctgtcttactctagtcgaggggcgtagggaacaacgagtcgtgtcgttacgggttccgggngggtacggaccgtaggtccgtacggttcccgttacggtttacggcccaacggcccgttacgggccctcccgtacccccgtccggtaccctcgttcccttccccgggttccccgtccccg

SEQ ID NO: 403285 - DNA, 644 bp, Homo sapiens
  misc_feature: GZ8MTXP01B2F1X.13.11.A11.1.454.CMB.2.raw
  modified_base (253)..(253): a, c, t, g, unknown or other
  modified_base (264)..(264): a, c, t, g, unknown or other
  modified_base (344)..(344): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttcgtccctatgacatatattggaccacagagcgaggatccnccctagttccncgtgagttcaggtacaactcaagactaaacgcgagggctcgtggacctccccagccgtcttcgtcgtggactccgaaggntacgacttacccgacaacgcgagggtactacttactctagtcctcgtggtcctacgtagtcgtacgaacgtagtcgacggtctacgtaactttattacgttgggtttacgtacgtttacggactaaaccgaaccgaaccgtccgtagggtaccttccggttaccgggaaccggttcgggaacccgtaccgggttccgtaccccggttaccgttaccggggtaccacccgggaccccgaaacgggtaacccccaacccccgtaagtttccgaccttaccgttccttcccggttaacccccc

SEQ ID NO: 403286 - DNA, 656 bp, Homo sapiens
  misc_feature: GZ8MTXP01BNDPU.13.11.A11.1.454.CMB.2.raw
  modified_base (250)..(250): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgtgtcctatgacatatatggtaccacagagcagggatccncccagttctccgtgagttcaggtcaaactcagataaacgcgaggctcgtggacgtcccacgccgtcttctcgtaggaacctccgaaaggtatcgacgttacccgaaccaacggcgaaaggggtataacgttacctcgaacttctcgtgggtacctcccgaagtcctaggaccgtagttcggaacggtctagtaacctttaagtttaccgtttgggttttacggtacgtttcggaacctaactaaaccgtaaccggtccgttaggtaacttccggtttaccggacccggtttcggggaaccctacgggttccctaacccggttccgtaacggtcgaacccgcccgaaaccgggaaccccaaccccgtaacgttccggccttaccgttccgttcccggtttccccccg

SEQ ID NO: 403287 - DNA, 716 bp, Homo sapiens
  misc_feature: GZ8MTXP01DJE5N.13.11.A11.1.454.CMB.2.raw
  modified_base (242)..(242): a, c, t, g, unknown or other
  modified_base (689)..(689): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgttcttccctctctgcttctcctggagcgtcagccagtctcacctgcaccttgcgcagtgcacaatgttcgtcctatgacatatagttggtaaccanagacgcgagggactccctccctagttctcgtagtaggttcacggtacaaactcaagaactaaacgacgacgggtctcgtacggtaccgtccccgacgcccgtcttacctcgtcggtactacccggaaagggtactacgggtaaccttacccggaacccgaacggtaccgtaaaggggtaacttaacgttaacctctaacttccgtacggtacggggtccttaccgacgttaccgttggaaccgtagtaggacggtcgttacggtaactttaacgtttaacgtttcggggtttacgttaaccgttcggaaccaaaccgaaaccgtaaccgtcgttacgggtaacttccggttacccggaaccgttcgggaacccgtaacggttccctaaccggttccgtacgggtacacccggttacccgaaccggaacccaaacccctcgttaaccncgttacccttccgttcccgttcccccg

SEQ ID NO: 403288 - DNA, 657 bp, Homo sapiens
  misc_feature: GZ8MTXP01EF0AR.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgttcttccctctctgcttctcctggagcgtcagccagtctcacctgcaccttgcgcagtggcaacctaattgttcggtccctatgactatatattggtaccacagagcgagggtactccctccctagttcctcgtagtaggttcaggtacaaactcgaagaacgtaaacgacgtaggctcgtaggaccgtcccagccgtcttcgcgtaggacctaccgaaaggtgtgtaaccttcccgaactaacggcgaagggtaacttacttaacctcgtattcgtccgttaagggaccttccgaaggttcctaggaaaccgtagttgggacggtattaacgtaccttaaagtttacccgttggggttttacggacgtttcggaacaacaaaccgtacgtccgttaggtacttccggtacgtaccgaggaacccgtcggttacccaccgttacgaacgtaccgaccggacccaaacggcccctaaaccccttgtcgaccttccgttccgttccgtccccg

SEQ ID NO: 403289 - DNA, 380 bp, Homo sapiens
  misc_feature: GZ8MTXP01BDXSW.13.11.A11.1.454.CMB.2.raw
  modified_base (263)..(263): a, c, t, g, unknown or other
  modified_base (336)..(336): a, c, t, g, unknown or other
  modified_base (375)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagctttgctactttattctgtcacagtatggtagcacgtanactttggccagggaccaagctggagatcaagcgaactgtggctgcacatctgtcttcatcttcccgcatcctnaatagtacgtgactgagtcgggctggcaaggcgcatagnnnnnn

SEQ ID NO: 403290 - DNA, 415 bp, Homo sapiens
  misc_feature: GZ8MTXP01D2487.13.11.A11.1.454.CMB.2.raw
  modified_base (343)..(343): a, c, t, g, unknown or other
  modified_base (349)..(349): a, c, t, g, unknown or other
  modified_base (392)..(392): a, c, t, g, unknown or other
  modified_base (398)..(415): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagactttcactctcaccatcagcagactggaacctgaagtctttgcttattttattctgtcaccagtatggtaggtcaccgtactacgtttggccgaggggaccaagctggagatcgaagcgaatgtgctgcacatctgtcttcacttctcccgctntctagntagtacgtgacgtggacggcgggtactggacgtaagggccganaagtgnnnnnnnnnnnnnnnnnn

SEQ ID NO: 403291 - DNA, 632 bp, Homo sapiens
  misc_feature: GZ8MTXP01ET8E4.13.11.A11.1.454.CMB.2.raw
  modified_base (246)..(246): a, c, t, g, unknown or other
  modified_base (361)..(361): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgactatatagttggtaccganagaagccgagggactccctcccctagttcctccgtgacggttcaggtacaactcagaactaaacgacgaggctcgtggacgtcccgagccgtcttctcgtggtacctccgaaggntgtacttcccgaccaacgcgaagggattacttactcactctcgtgggtacctcgagttcgtcgacgagtggacgtctacggtaatttacgtttaaccgttggggtttacgtaacgtttgggacctaaaccgtaaacaccggtaccttagggtcttaccggttaccgggacccgttcgggaacccgtccggttaccgtacccgttacgtacggtcaccggcccgaaccggtcccaaccccgtaatcgaccttacctcttcccgttaaccccc

SEQ ID NO: 403292 - DNA, 590 bp, Homo sapiens
  misc_feature: GZ8MTXP01DKMCW.13.11.A11.1.454.CMB.2.raw
  modified_base (332)..(332): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtacccgacagaagccagggacgtcctccccagttctcctgaggttcaggtcaaactcagataaacgcaagggctctggacgtccccagccgctttcnctcggactccaaggatgaacttcccgccaacgcagggatatactcatctctgggctccgagtctagacgtatgaggcctagtaccttatttaccgtggttttacgaagtttggacaaacgtaaccaacggtccttagggtacttccgtttacggacccgttacggggaacctacggttccgtaacccgttcgttaaacgggtccaacggcccaaacgggccccaaacccctcgtcgtccacttcgaaccgtttccccc

SEQ ID NO: 403293 - DNA, 608 bp, Homo sapiens
  misc_feature: GZ8MTXP01EHRBW.13.11.A11.1.454.CMB.2.raw
  modified_base (335)..(335): a, c, t, g, unknown or other
  modified_base (354)..(354): a, c, t, g, unknown or other
  modified_base (520)..(520): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatattggtaccgacaggaagccagggactccctccccagtttcctccgtgaggttcaggtacaaactcagataaacgcagggctcgtggaccgtccccagccgtcttcncgtaggactaccgaaaggntcgaacttcccgacaacgcgagggtattactactcattctcgtacgggctcgagttcgtagaacgtatggacggtcttgaacgtttaacttcgtttagggtttgaccgtttggaccaacgaaaccgacgtcgtaggtacttccgttacggaacccgttggaacccncgggttcccaccggttcgacgggttccaacggttccccaaacggccccaaaccccgtcgtcgtaccaccgttccgttaaccgtccccg

SEQ ID NO: 403294 - DNA, 722 bp, Homo sapiens
  misc_feature: GZ8MTXP01BPX9M.13.11.A11.1.454.CMB.2.raw
  modified_base (309)..(309): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcacgcccaccctcagtcgtcccgtgtcccccaggacagacacgccagcatcacctgctactagaaataatgacagaataaatatacttcctgtactcagcagaagtcagccacgtccccgtgtgtcgtggtaccattctactacaagngtcgaccgtaacggccggtaccctacgacggggtactcccccgtaggacgtacgtactttcgtaacccgtcgtccgtacctaccgtcgtacgggaacctcgacgaccctactcgaccgtacccgattaccggacggtaccccgggtaaccgaggtaccgttaaggtagggtaacgtacggtacgggacgtttacggttaaacttttccgtttaaaccggtggttaccgacgggggtacggttaaccgggggacctaacgggcccttaacgggacccgtttcggcccgttcccgggttcccttaaagttcccggttacggtttaacccggggaccgttacccgggggtaacccaacggtttaaccccggaccccgttacgttaaccgggtcccgaaccccggtaaacccccggg

SEQ ID NO: 403295 - DNA, 760 bp, Homo sapiens
  misc_feature: GZ8MTXP01DMSXO.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcgcagtgcacatgtgtcctatgacatatattaggaccgacaggaacgccgagggacgtccctaccctagtttctccgtggtacggttcacggtacaaacgtacaaagtaacgtaaaaccgacgagggtccttacggtcgggaacccgttcccccgaggtcccgtctttccgtcgtacgggacctacccgaaaagggtcttacggtaccgttaccccggaaccgtaacggacgtaaaggggtactttaaactttaccgtactaaacgttccgttacgttacgggggtccctacccgtaggttccttagggaacgttagttcgggaacgtctacgtaactttaacgtttacgtttgggtttacgtacgttacggacctaaacgaaccgtaaccgtccgttagggttaccttccggttaccggaccggtcgggtaaacccgtccggttaccgttacccggttacccgttacgggtaccaacccggacccccgttaaaccgggccccctaaaaccccgtcggttaccgtacccgttacccgttttccgttccccgtttaacccccc

SEQ ID NO: 403296 - DNA, 810 bp, Homo sapiens
  misc_feature: GZ8MTXP01DCLQ6.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagagccagggagtccctccccagtttctccgtgaggttcaggtcaaactcagaataaacgacagggtctcgtggacgttcccccaggcccgtctttaccgtcgtacgggtaaccttcccgaaaagggtacgttacggtacgttttaacccccgggacccaaaccgggccgtaaacgggggtaaactttaacgtttaacccgtaccaaacgttcccgttaccggttcgggggtacccttaccccgtaaaggttccgttacgggaaaccgtagttaggggaacgggtccctttaggaacctttaagtttaacccgtttgggggttttacggaaccgttttacgggaccctaaaccgaaaccgtaaccggtccgttaacgggtactttacccggttaccgggaacccgtttacgggggaacccctaacggggttcccgtaaccccggttacccgttaacggggttccccgaaaccggttccccggttaaaaccggggcccccctaaaaaccccccgttcgtccggttacccttaacccgtttccccgttaacccggttttcccccccccg

SEQ ID NO: 403297 - DNA, 659 bp, Homo sapiens
  misc_feature: GZ8MTXP01CQ0V9.13.11.A11.1.454.CMB.2.raw
  modified_base (198)..(198): a, c, t, g, unknown or other
tcagtcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccgaggggaaangcccaccctctcctgcgagggccagtcagattgcagcagcaactacttagcctggtaccagcagagcctggccacggcccccaggcctcctcactctacgatgtattcgaggacggaccacgtgacactccagacaggttcaggtcggacaggtgggtcgtcggggaaacacggtccttctaacctcctacacctatcgacgcagtacgtaggaacctagtaacgtactttacgtacttacttttattcgttactactaaccgttagggttacgttagggttacgttaccgtaacccgtttacgtacggttttacgggacccggtaacgggggtaaccctaagggtccgttaggggaacgtaacgttacggaaacggttccggtaaacgtcgggttaacggttccgttcggtaaccctaccgtaactttcgttacgttcctttaaccgaacttttcccccg

SEQ ID NO: 403298 - DNA, 738 bp, Homo sapiens
  misc_feature: GZ8MTXP01ACIJ1.13.11.A11.1.454.CMB.2.raw
  modified_base (172)..(172): a, c, t, g, unknown or other
  modified_base (270)..(270): a, c, t, g, unknown or other
  modified_base (293)..(293): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggancgtcagccagtctcacctgcaccttgcgcagtggcaccaatgttggtccctatgacatatatggtaccgacagaagcaggacgtcctccccagtttcncctgaggttcaggtcaaactcanaataaacgacagggctctgggacgtccccagccgtcttcgtcgtcggactaccgaaggtactaggtaaacttcccgaacccgaaacggcccgaaagggggaacttaacggttaactctaaacttccgttaccgttacggggccctttaaccccggtacgttaccgtacggtaacgtaacggtacggtacgggttcgttaagttaaccgtttaacgtttacgggtttacggtttacggttaacgttacggaacctaaaccgtaaaccgtaaccgtaccggtacggtaccgttaccggttaccgggtacccggttaacggggaacccgttaaccgggttacccgttaacccggttacccgtaacgggttcccgaacccggaaccccgaacccggaccccgttaacccctaccgttacgttacccgttaacccgttccgttaaccccg

SEQ ID NO: 403299 - DNA, 606 bp, Homo sapiens
  misc_feature: GZ8MTXP01EPR9S.13.11.A11.1.454.CMB.2.raw
  modified_base (260)..(260): a, c, t, g, unknown or other
  modified_base (350)..(350): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtccctatgactatatattggtaccgacagaagcgagggactccnccccagttctctgagttcaggtcaaactcaagataaacgcgagggctcgtggacgttccccgagcccgtcttctcgtggactccgaaggntgactcccgacaacgcgagggatattactcatctctgggactcgagtcagacgatggagctagtacttattacgttgggtttacgtacgtttcggacctaagaaacccgacgtacccgtagggtactaccggttccggaacccgttggggaacccctacgggttcctacccggttccgtacggggtccaccgccccgaaacgggtcccctaaacccctcgttacgtaccttaccttcccgtttccgttaacccccc

SEQ ID NO: 403300 - DNA, 567 bp, Homo sapiens
  misc_feature: GZ8MTXP01B3SJ0.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtccctatgacatatattggtaccgacagaagccagggagtccctccccagtttctcctgaggttcaggtcaaactcagataaacgacgagggctcgtggacgtccccagccgtcttctctggactaccaaggatgacttcccgccaacgccaagggacttagtactcatctctggctcagtctgacgatgagctgactattactggtttgacttggactaacgaacaaccgcctaggcttcttaccgggaccttcggggaaccctacggttacctacccggttccgttacggtccacgccccgaaacgccccgaacccctaacgtcgtaccaccgtccttcgttcccccccg

SEQ ID NO: 403301 - DNA, 664 bp, Homo sapiens
  misc_feature: GZ8MTXP01CNIUW.13.11.A11.1.454.CMB.2.raw
  modified_base (268)..(268): a, c, t, g, unknown or other
  modified_base (306)..(306): a, c, t, g, unknown or other
  modified_base (373)..(373): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaattgttcggtcctatgactatatagttggtaccgacaggaacgccgaggggtactcccncccctagtttcctccgtggaggtttcaggtacaaactnaagaactaaacgacgagggctcgtggaccgtccccaggcccgtcttcgtcgtcggactaccgaaggntacgacttacccgaccgaacgcgaaagggtattactacactactccgtcgtcgggcctaccgtagtcgtggaacgtagtagacgggtacttgtaacttagttaccgttgggtttacgacgtttggaacctaaacgaaaccgtaccggcgttaggactttcccggtacggacccggtcgggaaccctaacgggttccaaccggttccgtaaacgggccgttaacccggaccccgaaccgggaaccccctaaaccccggtgtccgtaccttaccgttcccgttcccgtccccg

SEQ ID NO: 403302 - DNA, 677 bp, Homo sapiens
  misc_feature: GZ8MTXP01CN6UI.13.11.A11.1.454.CMB.2.raw
  modified_base (240)..(240): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttcgtcctatgacatatattggtaccganagacgccgagggactccctcccgtagttcctcgtgtacgttcacggtacaactcagaactaaacgcgagggctcgtacggaccgtcccgagtccgtcttctcgtagacctaccgaaaggtctacgtacgttacccgaccaacggaccgtaagggtaacttaacttacctacgtaacgttcctacggtcgggtacccttaccggagttccgtagggaccgtaagttcgggaaaccgggttacgttaacgttaacgtttacgtttacgtttacggggttacgtaacggttaccggaaacctaaaccgtaaccgtacccgttcgtacgtacgttccggtacggaccgtacggtaacccgtacgttcccgtaccgttcgaaccggtcaccgaccgaccgaaccctaccgtgtcctaccttaccgttccgttcccgtccccg

SEQ ID NO: 403303 - DNA, 575 bp, Homo sapiens
  misc_feature: GZ8MTXP01C3T25.13.11.A11.1.454.CMB.2.raw
  modified_base (335)..(335): a, c, t, g, unknown or other
  modified_base (355)..(355): a, c, t, g, unknown or other
  modified_base (395)..(395): a, c, t, g, unknown or other
  modified_base (414)..(414): a, c, t, g, unknown or other
  modified_base (545)..(545): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacatgttcgcctatgacatatattggtaccgacagaagccaggggactcctccccagtttctcctgtaggttcaggtacaaactcaagaataaacgacaggctcgtggacgtccccgagccgtctttcncgtaggacctccgaaaggtntcgacttaccccgacaacgaccgaagggtattaacttacncatctctgggctccagtcngacgatgagctgattattcgttggttgacgttgactacaacgacgccgttaggacttaccgttcggaccgtggaacccgtacggcctaacccgttcgtacgggtcaccggcccaacggccccaaacccctntacgtccacctttccgttcggttccccccg

SEQ ID NO: 403304 - DNA, 630 bp, Homo sapiens
  misc_feature: GZ8MTXP01BE95V.13.11.A11.1.454.CMB.2.raw
  modified_base (193)..(193): a, c, t, g, unknown or other
  modified_base (239)..(239): a, c, t, g, unknown or other
  modified_base (343)..(343): a, c, t, g, unknown or other
  modified_base (424)..(424): a, c, t, g, unknown or other
  modified_base (539)..(539): a, c, t, g, unknown or other
tcagtcacgtactacacgaccggtgctcgatttagctacgactgcagggggctgggcctcaggaggcagcatcggaggtgcctcagccatggcatggatccctctcttcctcggcgtccttgcttactgcacagaatccatggcctctatgagttgactcacgcccaccctcatcgtccgtcgtcccccgganagaccagcctacactccacctgctcgtggatatgtattgactaagngtatggtctggtatcagcagagcacggccacgcccctgtccctactactacgttacctttaacgaaaactcccgacggcccggtcccgtcgtacgggggtcccnggtacgccggtacttccgcccccggtcctccggtcgtaccgtacggggaaaaccacgtcgtacctaccgtctacgacctancgaacggacccgggaccacgccgttaagttgatggacgtctcgtacttctcgttgtcgacgggggtcggtacgggacaacgtgcgtgtcggtacggtcgggcgggtacggaccgnggtcgtacggttccggtacgttcggcacggcccgacggttccgtcccggtcccctccggtcctccgttcctttcccgttaacccctccccg

SEQ ID NO: 403305 - DNA, 628 bp, Homo sapiens
  misc_feature: GZ8MTXP01B1NP3.13.11.A11.1.454.CMB.2.raw
  modified_base (584)..(584): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgacatatattggtaccgacaggaacgccgagggtacgtcccctcccctagtttcctccgtggtaggttcaggtacaaactcaagaactaaacgactagggctcgtggacctccccgagtcccgtcttactcgtaggtacctaccgaaagtctacgtacttacccgaccaacgcgaagggtacttattactctatctcgtcggcctcgagttcgagaccgtagtcggacgtcttagtaactttagtttaccgttggggttttacgtacgtttcggaccaacgtaaaccgaccgttcgtagggtaacctttcggtaacccggtcgttccgggaacctcggttccgtaaccgttcgtaacgcncgacccgacgtaaccccacctgtcacttcctcgttcccgtcccc

SEQ ID NO: 403306 - DNA, 579 bp, Homo sapiens
  misc_feature: GZ8MTXP01C3T63.13.11.A11.1.454.CMB.2.raw
  modified_base (395)..(395): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcccagtctcacctgcaccttgcgcagtggcacaatgttgtcctatgacatatattggtaccacagacgcgaggagtccctcccagtttctcctgaggttcaggtacaaactcaagaactaaacgacgacgggctcgtggaacgtccccgagccgtcctttctctacggactaccgaaggtatcgacttccccgacaacgcgaagggtattaacttacnctactctcgtgggctaccagtctagacgtagtgacggtctagacttatttacgttggtttacgacgtttggacctaacaacgaacgctaagtgtaattcgtacggccgtgggaccacgggtccaccgtccgcggttcacgacccgaacggccccaacctctcgttacctaacttccgttaaccc

SEQ ID NO: 403307 - DNA, 586 bp, Homo sapiens
  misc_feature: GZ8MTXP01BUAM3.13.11.A11.1.454.CMB.2.raw
  modified_base (190)..(190): a, c, t, g, unknown or other
  modified_base (236)..(236): a, c, t, g, unknown or other
  modified_base (248)..(248): a, c, t, g, unknown or other
  modified_base (313)..(313): a, c, t, g, unknown or other
  modified_base (326)..(326): a, c, t, g, unknown or other
  modified_base (441)..(441): a, c, t, g, unknown or other
  modified_base (461)..(461): a, c, t, g, unknown or other
  modified_base (492)..(492): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctcgtggagtatgtattgaactaacgngtatgtctgtancagcagagcagccacgccccctgtcctactcatacttacaaatccaggccgcctcgcggggtccngagtcgagttccnccccggcctccgcgtcgtacgggaaaccacgaagtccacgttcacgaccatacgacggaccggacccacgtcctagttcgagtaggacggtctcggttacttcttcgtgtacggnggggtacggacggacaacgngcgtcgcgtcgggtcggcgggtacggtacgnggtcgtcggttaccgtcgttacggaccgtacgacccgacggccctcccggtccccgtcgtacccgtccgttcccgttccccgttccccgtcccg

SEQ ID NO: 403308 - DNA, 413 bp, Homo sapiens
  misc_feature: GZ8MTXP01BP6ZB.13.11.A11.1.454.CMB.2.raw
  modified_base (404)..(413): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtgcaggtgggtctgggacagacttcactctcaccatcagcagactggaaacctgaagtctttgcttacttttattctagtcaccagttatggtaggtcacgtactacgttttggcctaggggacccaagctaggagatcaagcgaaactgtggctgcaccatctgtctcacttctcccgctatctagtaatagtacgtgactggacggcgggtctggcgaaagggcacgtatagcnnnnnnnnnn

SEQ ID NO: 403309 - DNA, 714 bp, Homo sapiens
  misc_feature: GZ8MTXP01EIALE.13.11.A11.1.454.CMB.2.raw
  modified_base (241)..(241): a, c, t, g, unknown or other
  modified_base (289)..(289): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcgtcctatgacatatagttggaccanagaagcgaggagtccctcccagtttctctgtaggtcaggtacaaactnagataaacgacgaggctcgtggacgtcccagccgtcttctcgtaggacctaccgaaaggtctacgtacttaacccgaccaacgcgtaaaggggtacttaactttacgtactaacttccgtcgtcggggtacctaccgaaggttccgtaggtaaccgtagttagggacgggtacttacggtaactttaactttaccggtttaggggttttacgaaccggttttcggaacccaaaccgtaaaccgtaaccgtaccggttaggtaccgttaccgtttacccggggaccgttcgggggaaccccgtacgggttacccgtaccccggttcggtaaccgggttaccgaaccggttccccggttaacgggtccccgttcccggtccccccgttcggggtccttaccccgttccgttccccgtttcccccccg

SEQ ID NO: 403310 - DNA, 589 bp, Homo sapiens
  misc_feature: GZ8MTXP01C0UCH.13.11.A11.1.454.CMB.2.raw
  modified_base (173)..(173): a, c, t, g, unknown or other
  modified_base (256)..(257): a, c, t, g, unknown or other
  modified_base (260)..(260): a, c, t, g, unknown or other
  modified_base (278)..(278): a, c, t, g, unknown or other
  modified_base (296)..(296): a, c, t, g, unknown or other
  modified_base (344)..(344): a, c, t, g, unknown or other
  modified_base (477)..(477): a, c, t, g, unknown or other
  modified_base (484)..(484): a, c, t, g, unknown or other
  modified_base (490)..(490): a, c, t, g, unknown or other
tcagtcacgtactacacgaccggtgctcgatttagctacgactgcagggggcctgggcctcaggaagcagcatcggaggtgcctcagccatggcacggatccctctcttcctcggcgtccttgcttactgcacaggatccgtggcctcctatgagctgactcagcccaccctnagtcgtccgtcgtccccaggacagacagccagcatccacctgctacgtaggtaaataagtggacagaataatatactctgtannagnagatcagccagtccctgngctgtcatctatcgaagntcgacccgaagccggacctgaacgggctcccgtagacgtcgtattccncgtacggcctaacccaaacgtccgggtagggtaaaccctcaacgtccccatacctacgacctagccgacgggtacccgggacccaggtctaggtcgagtcggaagtccttaggtaacttagtacgtgaccggnggtcggnggaccngtcagcctcgccgtcgttattcgttcgttaccgacggttaaccggttggaaccgtaacgtccgtaaccgtacgacgttacctaaccgaaccccgaaccg

SEQ ID NO: 403311 - DNA, 669 bp, Homo sapiens
  misc_feature: GZ8MTXP01D67NS.13.11.A11.1.454.CMB.2.raw
  modified_base (246)..(246): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcaggtgcaccaatgttcgtcctatgactatatagttcggaaccganagaacgccgaggactccctccctagttcctcgtgtaggttcgaggtacaaactcgaagtaactaaacgacgacgggtactcgtaggacccgtcccgacgtccgtcttcgtcgtagtacctaccgaaagtgtacgtactacccgaccaacgacgaagggtactacgtactcacttcgtcgtcggctacgagtcgtaggaacgtagtacggagtctagtaactttagtttaaccggtttgggtttacgtacgttacggaaccctaactaaaccgaccggtcgttacggtaccttccggttaccggtaccgtaacggggtaacccgtacgggttccgtaacccgttcgtaaccggtcacccggacccgttaaaccggaaccccaacccgtaacgttcgtacccttacctccgttccgttccccccg

SEQ ID NO: 403312 - DNA, 702 bp, Homo sapiens
  misc_feature: GZ8MTXP01B12EA.13.11.A11.1.454.CMB.2.raw
  modified_base (250)..(250): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgccttcctcctggagcgtcagccagtcctcacctgctaccttgcgcagtggcacctaatgttcgtcctatgactatatagttcggtaaccanagaagccgagggactccctcccctagtttcctcgtgtacggttcaggtacaaactcaagaactaaacgcgagggtctcgtcggaccttccccgagtcccgctttacgcgtacggactaccgaaggtactcggtacttaacccgaccaacggcgtaaagggtacttaacgtactctaactcgtcgtgggtacctacgtagttaccgtggaaccgtagttcggaacggtactacgtaaccgtttaagttttaccgttaggggtttacgtaaccggtttcggaaccctaaaaccggtaaaccctaaccgggtccgttagggtacccgtttaccggttacccgggtaaccggttccgggaaccctacccggttcgtaacccgttcgtacggaccgaccgaccccgttaacggcccctaaaccgtcgttcggacttaccttccgttcccgtcccccg

SEQ ID NO: 403313 - DNA, 627 bp, Homo sapiens
  misc_feature: GZ8MTXP01CZ1NT.13.11.A11.1.454.CMB.2.raw
  modified_base (266)..(266): a, c, t, g, unknown or other
  modified_base (339)..(339): a, c, t, g, unknown or other
  modified_base (351)..(351): a, c, t, g, unknown or other
  modified_base (383)..(383): a, c, t, g, unknown or other
  modified_base (399)..(399): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttcggtccctatgactatatagttggtaccgacaggaacgccgagggactcccnccccagtttctccgtgagttcaggtacaactcagataaacgacgaggctcgtggactcccagccgcttctcgnggactccaaggntcgtactcccgacaacgcgagggtatactacncatctcgtcggctcgntccgtgacgtatgagctagtacttatttacgttggtttacgacgtttacgacaaactaaccgaaccgtccgtaggtacgttccgttaccgggaccgttcggggaacccgtaacggttcccgaacccggttccgttaaacgggtcccgaaacggccccgaaaccgggttaaccccaaaacccccgtgttacccggtaccttacccgtttccgttcccggtttccccccg

SEQ ID NO: 403314 - DNA, 622 bp, Homo sapiens
  misc_feature: GZ8MTXP01EI4XG.13.11.A11.1.454.CMB.2.raw
  modified_base (199)..(199): a, c, t, g, unknown or other
  modified_base (277)..(277): a, c, t, g, unknown or other
  modified_base (301)..(301): a, c, t, g, unknown or other
  modified_base (356)..(356): a, c, t, g, unknown or other
  modified_base (366)..(366): a, c, t, g, unknown or other
  modified_base (383)..(383): a, c, t, g, unknown or other
  modified_base (387)..(387): a, c, t, g, unknown or other
  modified_base (391)..(391): a, c, t, g, unknown or other
tcagtcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccgaaggggaaancgcccaccctctcctgcagggccaggtcagattgtcagcagactaaactacttacgcctaggtaccagcagaacgccnggccacggcccccaggcctccgtnactctacgatgtactcgaggacgaccacgtgacactccagacctaggtcagtcgngaggtggcgnggaacagtcttcactcncacntcancagtacgacgaactgaacgtacttcgtacttacgtttattcgtacgtacctacgtaagttacggttacggttaacgtaccgtaccgttacgtttaccggtttacgggacccgggtaaacggggtacccgtaaaggtccgttaaggggaactaacgttaacgaaacgttacgtaaacgtggttcgcttcgaaccaactcgtacttcggttcttaaccgttaacgtttccccg

SEQ ID NO: 403315 - DNA, 629 bp, Homo sapiens
  misc_feature: GZ8MTXP01DXQ92.13.11.A11.1.454.CMB.2.raw
  modified_base (238)..(238): a, c, t, g, unknown or other
  modified_base (339)..(339): a, c, t, g, unknown or other
  modified_base (595)..(595): a, c, t, g, unknown or other
  modified_base (603)..(603): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcactatgttcgtcctatgacatatattggaccanagacgcgagggactccctccccgtagtttcctcctggtacggttacacggtacaaactcaagaataacgacagggctcgtggacctcccgagccgtcttcncgtggacctacgaagtctgtaccgttacccgacctaacggagtaagggtaacttacgttacctacgtactccgttcgtcgggtacctcgtacgttcgtaggacgtagtggaggtcctagtacttaatttcgttgggtttactcgttacggacctaacgaacgtaaccgcgttagtacttccggtacggtaccgtacgggaaccctacggttccctaccgttcggtacgtccgaccgcccgaaccgcccctaaaccncgttaacnccttaccgttccttcccgttaacccc

SEQ ID NO: 403316 - DNA, 722 bp, Homo sapiens
  misc_feature: GZ8MTXP01B50OU.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgttgtcctatgacatatatggtaccacagaagccgagggactcctcccctagttctccgtgaggttcaggtacaaactcagaactaaacgcgagggctcgtggaccgtcccaggcccgtctttcgtcgtacgggaccttaccgaaaggtactacggtacgttaccccggacccaacggcgtaacggggtaacttacgttacctactaacttccgttccgtgggtcccttacgaggttccgttacggaaacggtagttacggacgggtcttacggtaactttaagtttaccggttggggtttacgtacgtttcggaacctaaaccgaaaccgtaaccggtcgttagggaacctttccggtaccgggtacccgttcggggaaacccgtaccggttacccgtaaacccggttccgttaaacggggtcccaacccgggttaccccgaaaacccgggtaaccccaaaccccgtcgttaccggtcccttacccgttcccgtttcccggttaaccccccc

SEQ ID NO: 403317 - DNA, 755 bp, Homo sapiens
  misc_feature: GZ8MTXP01ASMDP.13.11.A11.1.454.CMB.2.raw
  modified_base (240)..(240): a, c, t, g, unknown or other
  modified_base (257)..(257): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggttgtgctgactcagccgtcttccctctctgcttctcctggagcgtcagccagtctcacctgcaccttgcgcagtggcacaatgttcgtcctatgacatatatggtaccanagactcgagggactccnccctagttctccgtgtacggtcacggtacaaacgtcaagaacgtaaaccgagacgggctacggtcggaaccgtccccgagtcccgtctttaccgtcgtcggtacctaccgaaggtaacgtcggtaacttccccggaccgaacgcgtaaaggggattacttactcatcgtctaggggtccttaccgacgttccgtaggaaccgtagtacggtacgggtacttacggtaatttaactttaaccgtttggggttttacggtacgtttaccgggaacctaaaccggaaaccgtaaaccggtccgttaacggggtaacctttcccgggttaaccgggtacccggttacgggggtaaccccgtaacgggttaccccgtaacccgggttcgttaacggggtacccaacccgggttaccccggaaacccggggtaacccccaaacccccggtaacgtttcccgtacccgttaccctttaacccggtttcccgtttaaccccccccg

SEQ ID NO: 403318 - DNA, 441 bp, Homo sapiens
  misc_feature: GZ8MTXP01B40TI.13.11.A11.1.454.CMB.2.raw
  modified_base (425)..(425): a, c, t, g, unknown or other
  modified_base (431)..(441): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcaggtgggtctgggacagacttcactctcaccatcagcagactggaacctgaaacgtctttgacttacttttattctcgtctacctagtagtggtaggtccaaccgtactacgttttggaccgaggggaccaagcgtaggagactacgaagacgaatgggtcggactgacgactattctgttccttcactttcctcccgcctatcctagtaagttacgtacgcgtacgtggacgggcgggctggacgaagggcganagtagnnnnnnnnnnn

SEQ ID NO: 403319 - DNA, 658 bp, Homo sapiens
  misc_feature: GZ8MTXP01ANAYC.13.11.A11.1.454.CMB.2.raw
  modified_base (244)..(244): a, c, t, g, unknown or other
  modified_base (387)..(387): a, c, t, g, unknown or other
  modified_base (412)..(412): a, c, t, g, unknown or other
  modified_base (419)..(419): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgactatatattggtaccganagaagccagggacgtcctccccagtttctcctgaggttcaggtacaaactcagaataaacgacagggctcgtggacgtccccagccgtcttctcgtggactaccaaggatgacttacccgccaacgcgaagggatacgttacncatctcgtggctcgagtctgaacgntgacggntagtacttatttacgttggtttcgacgtttggacctaaacgaaacgtaaccggccgttagggtactttccggttaccggggtaaccccgtgggggaacccctaacggggttcccgtaaccccggttacccgtaacggggttacccgaaccggacccccgaaaccgggaaccccctaaacccccgtaacgttaccggtccccttaacctttccccggttcccgggtttaacccccccccg

SEQ ID NO: 403320 - DNA, 396 bp, Homo sapiens
  misc_feature: GZ8MTXP01EYV3Y.13.11.A11.1.454.CMB.2.raw
  modified_base (350)..(350): a, c, t, g, unknown or other
  modified_base (384)..(384): a, c, t, g, unknown or other
  modified_base (389)..(396): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctggggacagacttcactctcaccatcagccagactggaacctgaaagtctttgcttacttttattctgtcaccagtatggtaggcaccgtatactttggccaggggaccaagctggagatcgaagcgaactggtgctgcaccatctgtcttcattctcccgctatctagntagtacgtgactggacgcgggctggacaaggcanatagnnnnnnnn

SEQ ID NO: 403321 - DNA, 664 bp, Homo sapiens
  misc_feature: GZ8MTXP01AL5UW.13.11.A11.1.454.CMB.2.raw
  modified_base (241)..(241): a, c, t, g, unknown or other
  modified_base (259)..(259): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttggtccctatgacatatattggtaccanagagccgagggactcccncccctagttctccgtgaggttcaggtacaaactcaagactaaacgacgagggctcgtaggacgtccccgagccgtcttctcgtaggacctaccgaaggatcgtacttcccgaccgtaacgacgaagggtattacgttactactattcctcgtcgggcctcgagtctaggaacgagttaggacgggtacttagtaaccttagtttaccgttggggtttacgtaccggtttggacctaaacgtaaaccgacgtcccgttaggtaccttccggttacccggtaccgttcggggaaccctacgggttccgtaccccggttccgtaacgggtcccaccggaccccgaaccgggtaacccccaaaccccgtcgttacgtcccttaccgttcccgttaacccggttcccccg

SEQ ID NO: 403322 - DNA, 663 bp, Homo sapiens
  misc_feature: GZ8MTXP01BNYEY.13.11.A11.1.454.CMB.2.raw
  modified_base (248)..(248): a, c, t, g, unknown or other
  modified_base (447)..(447): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacctaatgttcggtaccctatgactatatattggtaccganagaacgcgagggacgtccctcccctagttcctccgtggacggttcaggtacaacgtcaagaactaaacgacgaggctcgtaggacccgtcccacggcccgtcttccgtcgtacggacctaccgaaggtactcgtacgttcccgacgaacgcgtaagggattacttactctactctcgtcggtcctcgagtctaggacgngtggacgtcttcgtaacttagtttacgttgggtttacgtacgttcggaaccaacgtaaaccgaccgttacgtacggtacttacccggttacggacccggttgggaaccccgtacggttacccgtaccccggttcgtaacgggtccgacccggccccgttaaaccggcccccaaaccccgtcgttacgtccaccgtttccgttccccggttcccccg

SEQ ID NO: 403323 - DNA, 747 bp, Homo sapiens
  misc_feature: GZ8MTXP01DAIDV.13.11.A11.1.454.CMB.2.raw
  modified_base (258)..(258): a, c, t, g, unknown or other
  modified_base (356)..(356): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatattggtaccgacagagccgagggagtcccncccagtttcctccgtgtaggttcaggtacaaactcaagaactaaacgacagggctcgtggacgtccccagccgtcttctctggaccttccgaaaggtntcgacgttacccgacctaacggccgtaaggggtaacttacgttacctacaacttccgtaccgttggggtccttaccgtagtaccgttacggaacgtagtacggtaagggtccttaaggtacctttaagtttaccgttgggttttacggtacgtttcgggacctaaacgtaaccaaacgtcccgttaagggtacgttaccgtttaccggggaccccgttgggggtaaaccccgtaccggggttacccgtaaccccgggttcccggttaaacggggttccccgaacccgggacccccggaaaaaccccggggtttccccccaaaaacccccccgtcgtttaccccgggtaaccgttacccctttcccgttccccggggtttttcccccccccg

SEQ ID NO: 403324 - DNA, 648 bp, Homo sapiens
  misc_feature: GZ8MTXP01C15ZT.13.11.A11.1.454.CMB.2.raw
  modified_base (200)..(200): a, c, t, g, unknown or other
  modified_base (267)..(267): a, c, t, g, unknown or other
  modified_base (379)..(379): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcnagtgcacaatgttggtcctatgactatatattggaccacagaacgcgaggacgcctccctagtttcnccgtagtacggttcagtacaaactcaagaataaacgacgagggctcgaggaccgtccccgagccgtattctcgtacggtactacgaggatcgtaaactcccgaacgtaacgngaaagggtatactactacactcgttcgtcggtctacagttcctaggaccgagttcggacggtactacgttaactttagttttaccggtttaggtttcggtaaaccgtttcggaacctaaaaccgaaacgtaaccgttaccgtaggtaaccgttcgttaccggacccggttaaggggaaccttacgggttccaaccggttaccgtacggttacgccgacccgaaccggtaccccaaccctcgtacgttacctaaccgttccttaaccccg

SEQ ID NO: 403325 - DNA, 610 bp, Homo sapiens
  misc_feature: GZ8MTXP01EIE6H.13.11.A11.1.454.CMB.2.raw
  modified_base (329)..(329): a, c, t, g, unknown or other
  modified_base (429)..(429): a, c, t, g, unknown or other
  modified_base (579)..(579): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcgcagtggcacctaattgttcggtccctatgactatatagttggtaaccacaagaacgccgagggtacgtccctcccctagtttctccgtggtacggttacaggtacaaactacgaagtaacaaacgacgnggcttacgacggaccgtccccgagccgtcttacgtcgtaggtaccctaccgaaggtactacgacctacccgaccgaacgacgtaagggtattactctacnttcgtcgtcggtctaccgtagttcgaggaaccgtagtaggtaacggtcttacgtaactttagttacgtttaggggtttcgtaacgttcgaacctaacgaaccgacgtcgtagtacttcgtacggaccgtcggaactcgcacgttgcgacncgccacgccaccgctcgcactcgttcctccc

SEQ ID NO: 403326 - DNA, 386 bp, Homo sapiens
  misc_feature: GZ8MTXP01A25UY.13.11.A11.1.454.CMB.2.raw
  modified_base (357)..(357): a, c, t, g, unknown or other
  modified_base (374)..(374): a, c, t, g, unknown or other
  modified_base (380)..(386): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgtcggccatgggaccaaggtggaaatgaaacgaactgtggctgcaccatctgtcttcatctcccgcatcctgatagtacgtgaactgngcgggctgggcaaggcncatagnnnnnnn

SEQ ID NO: 403327 - DNA, 697 bp, Homo sapiens
  misc_feature: GZ8MTXP01ED1OI.13.11.A11.1.454.CMB.2.raw
  modified_base (262)..(262): a, c, t, g, unknown or other
  modified_base (360)..(360): a, c, t, g, unknown or other
  modified_base (397)..(397): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgactatatattggtaccacagaagccgagggactcccncccctagttctcctgacggttcaggtacaaactcaagaataaacgacgagggctcgtggaccgtccccagccgtcttctcgtaggactaccgaaggtntacgacttacccgacaacgcgaagggtactacttacncacttctcgttgggcctaccgagttactaggtaacgagttggacggtacttcggtaaactttagttaccgtttggggtttacgtaacgtttcggactaaaccgaaaccgaaccggtcccgttaagggtaccttcccggttaccggggtacccgttgggggaaaccccgtaccgggttacccgtaaccccggtttaccgttaaccgggggacccaaccgggacccccgaaaacgggtaaccccccaaaaccccgtcgttccggtacccttacccgttcccgtttcccggttaacccccccg

SEQ ID NO: 403328 - DNA, 623 bp, Homo sapiens
  misc_feature: GZ8MTXP01C09XA.13.11.A11.1.454.CMB.2.raw
  modified_base (156)..(156): a, c, t, g, unknown or other
  modified_base (204)..(204): a, c, t, g, unknown or other
  modified_base (222)..(223): a, c, t, g, unknown or other
  modified_base (241)..(241): a, c, t, g, unknown or other
  modified_base (260)..(260): a, c, t, g, unknown or other
  modified_base (283)..(283): a, c, t, g, unknown or other
  modified_base (548)..(548): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctntctgcttctcctggagcgtcagccagtcctcacctgcctaccttgcgnagtgcacatgtcgcctannactatatattcggaccanagacgcgaggctcctcctnttctcgtgagtcagtacaaactnaagaataacgacgaggctcgtacggacgtccccgagccgtcttcgtcgtacggactacgaaggtctacgtaacgttcccgaacgtaaacgcgtaaagggtactacgttactactacttccgttacggtccgggtctaccgtagttcgtacggacgtagttcgaggtctaggtaactttagttaagttcgtttacgacttcggaacaaactaacgaacgtcgtagtcgttaccgtccggccgtaacgggaacccttcgggtacccncggttacccgtgttacccgccgaacccgaaccgacccctaacccgtacgtcgttaccctccgttcccgttccccg

SEQ ID NO: 403329 - DNA, 603 bp, Homo sapiens
  misc_feature: GZ8MTXP01DI0M9.13.11.A11.1.454.CMB.2.raw
  modified_base (211)..(211): a, c, t, g, unknown or other
  modified_base (222)..(222): a, c, t, g, unknown or other
  modified_base (285)..(285): a, c, t, g, unknown or other
  modified_base (367)..(367): a, c, t, g, unknown or other
  modified_base (548)..(548): a, c, t, g, unknown or other
  modified_base (558)..(558): a, c, t, g, unknown or other
  modified_base (569)..(569): a, c, t, g, unknown or other
  modified_base (584)..(584): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttanacagctccganaataggaactactagcttaggaccaacagaaaccaggacagcctcgtaagttactctttacgnggctcctacccgggatccggggtcctcgaccgtattcgagtggcaggtcggtctgggactagtactttcactctcacaatcngcacgtcctacgaggctagagtatggaggtactaggtttactaacgtgtacagtacaattagtactacttcctaccgttccttcccggtagggtacccgttcgggaacccgaaggggaccgtaagggggtaactaaacgtaacgaaaccgtaatcgggtaggcctacggaccctaaacgtnttcccggttnttccctttaanacctttcccgtcccnccttattccgaagttaacg

SEQ ID NO: 403330 - DNA, 817 bp, Homo sapiens
  misc_feature: GZ8MTXP01BF4YL.13.11.A11.1.454.CMB.2.raw
  modified_base (220)..(220): a, c, t, g, unknown or other
  modified_base (804)..(804): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagacctccctggctgtgtctcgtgggcgaggacgggcccaccatcaactgacaagaccagccagtagttgttttanacagtcctaccgaactaaagtaacggtaaaccttacttagtacctttacgggaaaccaaacaacgaaaacccgaggaccacggccccttaaccggtaaagtttaccgttaccgtttttacggtcgggggtacccgttaccccggttaacccccggggtaaacggttcccccgggggttcccctacggaaccccgtaagtttccggacggttacgggaccgtagggtccggggttacgtaggggaactacgttacctttaccaaccttctaccaaccctaactccgaacggctaacgtccccttacgagggtctaagggaaacgtgttaggtcggtacgtttaaagtttttactacgttacggtactaaccgtaattaaagtttacttaacttaaccgttacccgttaccggtacccggtaggttaccccttacggttaaccggttccgggggaacggtaacggggtaaacccgtaaggggtccgaaacgtaacgtaacgtaaaaccggtcgttggttaaccggcgtacgaaccttaaccgttgttcccttaaggttcccttaactaccggttccccttccccgngtttaacttccgg

SEQ ID NO: 403331 - DNA, 755 bp, Homo sapiens
  misc_feature: GZ8MTXP01BOXC3.13.11.A11.1.454.CMB.2.raw
  modified_base (244)..(244): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccanagaagccagggactccctccccagtttctcctgtaggttcaggtacaaactcaagaataaacgacgagggtctcgtggaccgtcccccaggcccgtcttactcgtcgggactaccgaaggtactcgaccgttaccccgacccaacggccgtaaaggggtaacttacgtttacctactaacgtttcccgtacggttcggggtccttacccgtaagggttcccgttagggtaaacccggtagtttacggggaccggggtacttacgggtaactttaagttttacccggttaggggttttacgtacgtttacgggacctaaaccgaaaccgtaccgtacccgttacgggtacttcccggtttaccgggtacccgtcgggggtaacccctaacggggttacccgtaccccggttaccgtaacgggtacccacccgggacccccgttaaacgggtcccccaaaacccccgtgttcccggttaaccttacccgttccgttccccggtttcccccccg

SEQ ID NO: 403332 - DNA, 436 bp, Homo sapiens
  misc_feature: GZ8MTXP01EBE6M.13.11.A11.1.454.CMB.2.raw
  modified_base (380)..(380): a, c, t, g, unknown or other
  modified_base (396)..(396): a, c, t, g, unknown or other
  modified_base (417)..(436): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggttgggtctgggacagacttcactctcaccatcagcagactggaacctgaagtactttgctatttattctgtcaccagtatggtacggcaccgtatacgttttggcctaggggacccaagcgtaggagatacgaagtccgaaactggaggctaggccaaccagttctgtcttaccacttcttcccgacaattcagtaatagttacgngtaactggaggcgggntagggcaaggtcgcaaagtgnnnnnnnnnnnnnnnnnnnn

SEQ ID NO: 403333 - DNA, 617 bp, Homo sapiens
  misc_feature: GZ8MTXP01AJHWW.13.11.A11.1.454.CMB.2.raw
  modified_base (244)..(244): a, c, t, g, unknown or other
  modified_base (259)..(259): a, c, t, g, unknown or other
  modified_base (268)..(268): a, c, t, g, unknown or other
  modified_base (285)..(285): a, c, t, g, unknown or other
  modified_base (295)..(295): a, c, t, g, unknown or other
  modified_base (302)..(302): a, c, t, g, unknown or other
  modified_base (316)..(316): a, c, t, g, unknown or other
  modified_base (320)..(320): a, c, t, g, unknown or other
  modified_base (370)..(370): a, c, t, g, unknown or other
  modified_base (526)..(526): a, c, t, g, unknown or other
  modified_base (588)..(588): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgctttctcctggagcgtcagccagtctcacctgcaccttgcgcagtggcaccaatgttcggtccctatgacatatattggaccganagaagcagggctccncccagttcncctgagtcagtcaactnaagataacgnaggctcnggactcccagccgnttcnctggacctccaaggctgacttcccgaccaacggcgagggtattacttacngacttctcgtaggggcctcgagttccgtaggaaccgtagtgacggtccttagtaacttacgtttaccgttggggttttacgacgtttcgggaaccaaccgtaaaccgaccggtcgttacggtacttaccggtttacggaccggttcggggaacccnccggggttaccacccgggttcgtaacgggtccaacggttccccgaaaggtccccctaaaccncgtactccgaccttccttcccgtaacccc

SEQ ID NO: 403334 - DNA, 796 bp, Homo sapiens
  misc_feature: GZ8MTXP01BUFR6.13.11.A11.1.454.CMB.2.raw
  modified_base (185)..(185): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgccttctcctggagcgtcagccagtcncacctgcaccttgcgcagtgcactaatgttcggtcctatgacatattagttgggtaaccgacaggaacgccgagggtacgttccctcccctagtttcctccgtaggtacggttacaggtaaccaaacttacgaaggtaactaaaacggaccgacggggtccttaccggttacggacccgttacccccgacggtccccgttctttccgtacgtacgggtaccctacccggaaaggggtacttacgtaaaccggtttcccccgaaaccggtaaccggtccgtaaaacgggggttaaactttaaccgtttaaaccttccgtaaaccgtttccggttacccgggttaacggggttccccttacccggtaacggtttcccgtaaggggtaaccgtaaggtccgggtaaggggttccctaggttaaccttagtttaccgttggggtttacgtacgttacggacaaacctaacgaccgtacgtacggtcgttaccggttcgggacccttggggaaccctcgggttacctacccggttccgacgggttaccaccggaccccgaccggaacccccaaccgtaacgtcgtacccttacttcccgttaacccgttaaccccc

SEQ ID NO: 403335 - DNA, 695 bp, Homo sapiens
  misc_feature: GZ8MTXP01BYFFI.13.11.A11.1.454.CMB.2.raw
  modified_base (245)..(245): a, c, t, g, unknown or other
  modified_base (263)..(263): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccgtggagcgtcagccagtctcacctgctaccttgcgcagtcgcacaattgttcgtcctatgactatatagttcggaccanagacgcgagggactcccncctagttctcctgtacgttcaggtacaactacagtaacgtaaacgacgaacgggtcctacgttacggaccgttaccccgacgtcccggtactttccgtcgttacggaccgttacccggaaaggtacgttacgtaccgtttacccgaacccgtaacggccgtaaaggggtactttaacttaaccgtctaacttccgttcggttcgggaacctttcccgaaggtttcccgtaggaaccggtttaagggtacggtacgtacgttacgttaacgtttacgtttacgttagggtttacgtacgtacgaacctaaccgtaacgtaccgtcgtacgtacgtccggtaccggtaccgtcggaaccgtacgttccgtaccgttacgtacgacgaccgccgaccgaaccctacctcgtctaccttcctccgttcccgtcccg

SEQ ID NO: 403336 - DNA, 632 bp, Homo sapiens
  misc_feature: GZ8MTXP01AB9NY.13.11.A11.1.454.CMB.2.raw
  modified_base (485)..(485): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttgtcctatgactatatagttggtaccgacagaacgccgagggactcccctccctagtttcctccgtggtacggttacgacggtacaaactcgaagaacgtaaacgacggacggtcctacggtacggaacccgtccccgacgtcccgtcttcgtcgtaccggactacggaagtactgtaaaccttcccgaacgtacgacggtaaggtacttactactactacgtctcggtacggctaccgagttgacgacgtgtggacgtctactaacgtttnttacggttgtacgtcgtacgaaccaacgacgacgtcgtagtaccgtcggtaccggaccggtaacggaccgttccgtaccgaccgtacgtacggacccgaccgacccgaaccgaccctaaccgtcgtcttacctcccgttccgtcccg

SEQ ID NO: 403337 - DNA, 729 bp, Homo sapiens
  misc_feature: GZ8MTXP01BBII6.13.11.A11.1.454.CMB.2.raw
  modified_base (200)..(200): a, c, t, g, unknown or other
  modified_base (238)..(238): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcncagtgcactatgtcgtcctatgacatatatggtaccanagacgcgaggactcctccctagttctcctggacgttcacggtacaaactcgaagaactaaacgacgacgggctcgtcggacgtccccgagccgtacttctcgtcgacctaccgaaggactacgacgttcccgaccgtaacggacgtaaggggtaacttaagttaccctagtacttccgtcgtacgggtccttaccgtaacgttccgtaggaaccggtagttacggaagggtcttacggtaaccttagtttaaccgttggggttttacgtacgtttcggaacctaaacgaaacccgtaacgtccgttaacggtaccgttccggttacccgggtaacccgttccggggaaacccgtacccggggttaccgtaaccccgggttacccgtaaacgggtcccgaacccggttaaccccgaaaacccggggccccctaaaaccccgtccgttaccggtaccccttaacccgttcccgtttcccggttaacccccccg

SEQ ID NO: 403338 - DNA, 659 bp, Homo sapiens
  misc_feature: GZ8MTXP01AKZ8R.13.11.A11.1.454.CMB.2.raw
  modified_base (188)..(188): a, c, t, g, unknown or other
  modified_base (199)..(199): a, c, t, g, unknown or other
  modified_base (215)..(215): a, c, t, g, unknown or other
  modified_base (230)..(230): a, c, t, g, unknown or other
  modified_base (291)..(291): a, c, t, g, unknown or other
  modified_base (631)..(631): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctctatgagttgactcagccacctcatcgtccgtcgtccccgganagacagcctanatcacctgctgtgganatgtatagactaagntatgtctggtatgagcgagagcacggccacgtccccctgtcctactctacttacctttaanaaaactccgacgggcccgtccgttcggtaccggggtcctagacggtcgtacttccggtcccccggtacctccggaccgttcggaggaaaaccacgtcgtcctaccgtcgacgacccagtacggaccggacccgggaccctacggtctagttacgagtacgggtactcgtttcgtaccgttacgtttcgtacgttacggacggggggtacgtacggggaacctaacggcggtcgtcggcgttcgggtcggacgggacggacccgtggtcgtccggttacgttacgttacgggtaccgacccggacgttacggttcccgtaacccgtccccgttcgtacccnccgtttcctccccgttccccttaacccg

SEQ ID NO: 403339 - DNA, 693 bp, Homo sapiens
  misc_feature: GZ8MTXP01AS0WB.13.11.A11.1.454.CMB.2.raw
  modified_base (249)..(249): a, c, t, g, unknown or other
  modified_base (304)..(304): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagcccgttcttccctctctgcttctcctggagcgtcagccagtctcacctgctaccttgcgcagtggacacattgttcgtcctatgactatattagttcggaccganaggacgccgagggactccctcccctagttcctcgtggtacgttcaggtacaactnaagaacgtaacgacgacgggactcggtacggaccgtccccgaggtcccgtctttcgtacggtacggtaacctaccgtaaaggtctacggtacctaaccccggaccgtaacggacgtaaagggtaacttaaccttaccgtactacgttccgttccgggttcgggcccttacggtacgttccgtaggaacgtaggttaggaacgggtcttaggttaactttagtttacgtttcggggtttatacgttcgaacctaaaccgaacgtaccgtcgtaacgcgttaccgtacggaccgtcggggaaccctcgggttcctaccggttcgtaccggacacccggacccgaaccggtccccaaccgtcgttacgaccttcttccgttcccgttccccg

SEQ ID NO: 403340 - DNA, 726 bp, Homo sapiens
  misc_feature: GZ8MTXP01D960E.13.11.A11.1.454.CMB.2.raw
  modified_base (253)..(253): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgttcgtcctatgacatatatggtacgacagagccgaggactccncctagttctctgtagtcaggtacaactcaagaactaaacgacgagggctcgtaggaccgtaccccaggtcccgtctttaccgtcgtacgggtaacctaccggaaaaggtcgttacgaaccgtttcccgaacccgaacggcgtaaacggggtacttaaactttaacctacgtaacttccgttccgtcgggtaccttcccgaaacgttccgttacggaaacggtacgtagggtaacggtccgttacgtaaacctttaagttttaccgtttaggggttttacgtaacgtttacgggaacccttaaacaaacccgtaaaccggtcgttaacggtcgttacccgttaccggggtaacccggttacggggtaaaccctacggggttacccgtacccggttacccgtaacggggttacccaaccgttacccgaacccggaaccctaaaccccggtctaccgtcttacgtccttccgtccc

SEQ ID NO: 403341 - DNA, 633 bp, Homo sapiens
  misc_feature: GZ8MTXP01A6C76.13.11.A11.1.454.CMB.2.raw
  modified_base (199)..(199): a, c, t, g, unknown or other
  modified_base (264)..(264): a, c, t, g, unknown or other
  modified_base (364)..(364): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcncagtggcacctaatgttcggtccctatgactatatattggtaccgacagaacgcaggacgtcccncccctagtttctccgtgaggttcaggtcaaactcgaagagtaaacgacgacggctcgtggaccgtccccgagcccgtcttctcgtggtacctaccgaagntacgacttacccgaccaacgcgtaagggtattacgttactctaatccttacgtcgggtacctacgtagttcgagaccgtagtcggtaaggtctaggtactttacgttacgttgggtttacgtacgtttcggacctaaacgtaaccgaaccgtcgttaggaccttcggttaccggaccgttgggaaccctacgggttccctcccgttacgtcggtaccgcgaccccgacggaaccccacggtctcgaccttctaaccgttcttaaccccc

SEQ ID NO: 403342 - DNA, 488 bp, Homo sapiens
  misc_feature: GZ8MTXP01CJT6D.13.11.A11.1.454.CMB.2.raw
  modified_base (303)..(303): a, c, t, g, unknown or other
  modified_base (353)..(353): a, c, t, g, unknown or other
  modified_base (471)..(471): a, c, t, g, unknown or other
  modified_base (473)..(488): a, c, t, g, unknown or other
tcagtcacgtactacacgaccggtgctcgatttagctacgactgcagggccagtcagattgtcagcagcaactacttagcctggtaccagcagaagcctggccaggccccccaggcctcctcatctacgatgtattcaggagaccactgacatcccagacaggttcagtggcaggtgggtctggacagacttcactcctcaccatcagcagactggaacctagaagtactttgactacttttatttctgtcaccagtagtggtacgtctaccgtacgtactttcggacccgagggacctaagngtagggaagatacgaaggccgaaacgtggtggtcctacgccaaacccctnttccgttcgttaccctttcctaccttccgttccccggacctattaaccgtacgtaacgtacgttacggtcgttacgtcggacgggtcgggcttacggggacaaacggtcgacaagtgngnnnnnnnnnnnnnnnn

SEQ ID NO: 403343 - DNA, 575 bp, Homo sapiens
  misc_feature: GZ8MTXP01BE3OQ.13.11.A11.1.454.CMB.2.raw
  modified_base (155)..(155): a, c, t, g, unknown or other
  modified_base (320)..(320): a, c, t, g, unknown or other
  modified_base (345)..(345): a, c, t, g, unknown or other
  modified_base (389)..(389): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctntctgcttctcctggagcgtcagccagtctcacctgcaccttgcgcagtggcaccaattgttggtccctatgactatatattcggtaaccgacaggaacgccgagggactcccctcccctagtttcctccgtgaggttcaggtacaaactcagtaactaaacgacngggctgaggactcccagccgcttcncgtggactccgaaggatcgactcccgccaagcaagggatatacnatctctggctccgagtcagacgatgagcgtagacttattcgttggtttgacgttcgactaacacgaacgtccgtaggcttaccggtacggtccgtcggaaccgtacgttccaacccggttcgtacggcgaccgaccgacgtcgtccccgtaaccccgtcggtccaccttcccgttccggtcccccg

SEQ ID NO: 403344 - DNA, 701 bp, Homo sapiens
  misc_feature: GZ8MTXP01CDSVZ.13.11.A11.1.454.CMB.2.raw
  modified_base (258)..(258): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacctgcgcagtgcacaatgttcgtcctatgacattatattggaccacagaagccgagggtactcccncccctagttcctccgtgaggttcacggtacaactacagaaataaacgacgacgggtctaccgtggaaccgtccccacgtcccgtctttcctcgtacggtaaccgtaccgaaaggtatacgtaacgttcccgaaccctaacggacgtaaacggggtaacttaacttacctactaacgttccttacggttcgggtccttaccgtacggttaccgttaggaacgtagttaggacggtctacggtaaccttaagtttacgttcggggttttacgtacgtttcggacctaaaccgaaacgtaaacccgtccgttaacggtacttccgttaccgggtaaccgtcgggtaacccgtaccggttacctacccggttaccgtaacggtacgacgacccgaacggaaccccaaacccgtaactcgtaccttaccttccgttcgttaacccccg

SEQ ID NO: 403345 - DNA, 809 bp, Homo sapiens
  misc_feature: GZ8MTXP01BF26E.13.11.A11.1.454.CMB.2.raw
  modified_base (253)..(253): a, c, t, g, unknown or other
  modified_base (780)..(780): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcgcaggtgcaacctaattggttcggtccctatgaactatatattcgggtaaccanaggaacgccgaagggtacgtccctccccgtaagtttcctccgtaggtacggtttcgaaggtaacctaaaacgtaccgaaagtaaacgttaaaacggaccgtaacgggggtaccttacggtacggtacccgttcccccgaagggtccccgttaccgtttaccgttccgtacggtaccccgtaacccgtaaaggggtactacgtaacccgttaaccccgaaacccgaacgggtacgtaaacggggtaacttaaactttaccgtactaacgttcccgtacgggttccgggaccttaccgtaggttaccgttaacggtaaaccggtgtagggtaaacggtcgttaaccgttacctttaagtttaaaccggtttggggttacgtttaaacggttccgtaaccgaaaccgtaaaccggtaccgtacccggttacggttaacttacccgggttaccggtaacccggtcgggaacccgtacggttaccgtacccgttaccgacgggtaccacgccgaacccggtcccaaaccctntacgtcccttacgtccgttcccgtccccg

SEQ ID NO: 403346 - DNA, 702 bp, Homo sapiens
  misc_feature: GZ8MTXP01E1RND.13.11.A11.1.454.CMB.2.raw
  modified_base (240)..(240): a, c, t, g, unknown or other
  modified_base (256)..(256): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacagtgttcgtcctatgactatatattcggaccanagacgcgaggcgtccnccctagttctctgagttcaggtacaaactcaagaactaaacgacgaggcttaccgtggacccgtccccaaggtcccgtctttcctcgtacggaccttaccgaaaggtagtacggtacttaacccgaaccgaacggcgtaaagggggtactttacgtttacctaactcgttcgtcgttcggggtacctacccgtagttacccgtaggtaaccggtagtacgggacgggtccttacgggtaacctttagttaacgttttcgggggtttagttaaccggtttacgggaccaaaccgtaaaccggtaccgtccgttaagggtaccgttccgtttaccgggacccgttacgggaacctccggttacgtaacccggttcgtacggtaccgaccgacccgaccggcccctaaaccgtcgtcggtccttaccttccggttaacccgttcccccg

SEQ ID NO: 403347 - DNA, 748 bp, Homo sapiens
  misc_feature: GZ8MTXP01AMDKB.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgacggttcaggtcaaactcagataaacgacagggctctggacgtccccagccgtcttctctggactccgaaggatcgacttacccggaccaacgggcgggggtaaattacgtttacctcgtaactccttacgtcggggtcctcccgaaggttccgttggaaccggtagttaggaacggggtccttagggtaacctttaatttaaccgtttgggttttacggggtaacgttttcggggacccttaaaccgaaaacccgtaaaccggtccccgttaagggggtaactttccggtttccggggtaaacccgttcggggggaaacccctaaccgggggttacccttaaaccccgggtttcccgttaacgggtttcccgaaccgggacccccgttaaacggggaccccccaaaacccccgtaccgttccggttaccctaacccgtttcccttaaccggtttcccccgttaaccccccg

SEQ ID NO: 403348 - DNA, 652 bp, Homo sapiens
  misc_feature: GZ8MTXP01BS767.13.11.A11.1.454.CMB.2.raw
  modified_base (416)..(416): a, c, t, g, unknown or other
  modified_base (556)..(556): a, c, t, g, unknown or other
tcagtcacgtactacacgaccggtgctcgatttagctacgactgcaggcaggggcagcaagatggtgttgcagacccaggtcttcatttctctgttgctctggatctctggtgccgtacggggacatcgtgataagccagtctccagacctccctggctgtgtctcgtgggcgaggacgggccaccatcaactgacaagaccagccagtagttgtttatacagcctaccgaacaaagtacggtaacttacttagcttacggaaccaacaacgaaaccaggacacgcctacgtaagttacttcgtttacgcgggtccgttaccggtaccccgggtacgtccccggggtcctacggaccgtattcgaggtcggcgacgggtcggtcgtgggactgtacctttcactctacacaactcngcacgtccttcgaggtctaggaatcgttggtcgtacttagtttactacgtagtacagtaactaattattaacttcgtaccctcttcccgtcggttcgggtaaccgttccggaaccggaacgggtaccgtaaggggttaanaaacgtaccgaaaacggtgtaaggtacgcgtacgactaccgtacgttcgttcttaccgttctaccttcccgttccccacttagtccgttggtaacg

SEQ ID NO: 403349 - DNA, 654 bp, Homo sapiens
  misc_feature: GZ8MTXP01BZN1R.13.11.A11.1.454.CMB.2.raw
tcagtcacgtactacacgaccggtgctcgatttagctacgactgcggggtaagaggttgtgtccaccatggcctggactcctctcctcctcctgctcctctctcactgcacaggttccctctcgccaggctgtgctgactcagccgtcttccctctctgcttctcctggagcgtcagccagtctcacctgcaccttgcgcagtgcaccaatgttgcctatgacatatattggtaccgacagaagccaggacgtcctccccagttctcctgaggttcaggtacaactcagataaacgacagggctctggacgtccccagccgtcttctcctaggacctccgaaggatcgacttaccgaccaacgcacggggtatacgtactcagtcctgtcggctaccagtctagacgagtcgagctgtactattacgtgggtttagtaccgtttaggacctaaaccgaaccgtaaaccgtccgtaacggggtacttacccgttaccgggtacccgttcgggggaaacccctaacgggggtttacccaacccggttacccggttaacgggttccgaacccggaccccgttaaaccggggtaacccccaaaccccggtaaccttaccgggttacccgaaccgttccccgttcggtttaaccccccc

SEQ ID NO: 403350 - DNA, 612 bp, Homo sapiens
  misc_feature: GZ8MTXP01AV9RP.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgctcagtggcaccaattgttcggtccctatgactatatattggtaccacagaagcgagggactccctcccctagtttctccgtggtacggttcaggtacaaactcgaagaactaaacgacgaggctcgtaggaccgtccccagccgtcttcgctggacctaccgaaggctgaccttacccgaccaacggcgaaagggtacttaacgttactacattcctacgtcgggacctccgaagttccttaggaccgtagtcggaggtcctagtactttattaacgttggtttagaccgttgactaacaacgtacgcgtaggtactcgtccgacgtcggaacctacggcctacggttccgtaggtcccagttcccaacggccccaacccgtgttcgaccttaccgtccgttcccgttcccccg

SEQ ID NO: 403351 - DNA, 682 bp, Homo sapiens
  misc_feature: GZ8MTXP01CBWXX.13.11.A11.1.454.CMB.2.raw
  modified_base (252)..(252): a, c, t, g, unknown or other
  modified_base (284)..(284): a, c, t, g, unknown or other
  modified_base (653)..(653): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccgtggagcgtcagccagtctcacctgcaccttgcgcagtgcaacctaagtgttcgtaccctatgactatattagttcggtaaccganagaacgccgagggactccctccctagtttccncgtgagttcaggtacaactcgaagaataacgacgaggtctcgtcggaccgtcccagcccgtcttctcgtggtaacctaccggaaagtatcgtaccttacccggaccgaaggtcgtaaagggtacttacttaaccgtctactcgttaccgtcgggtcctaccgtagttccgtaggaaccgtgtaggtacggtcttacgttaacgttaagtttaccgttgggggttttacgaccgtttcggaaaccaacgtaaaccgtaccgtcgtaacggtccgttaccggttaccgggaccgtcgggaacccctcgggttaccctaccggttcgtaacggtccaccggcccgaacccgtaaccccaaccccgtgttacnccttacccttccgttccccgttaaccccc

SEQ ID NO: 403352 - DNA, 799 bp, Homo sapiens
  misc_feature: GZ8MTXP01CHST2.13.11.A11.1.454.CMB.2.raw
  modified_base (253)..(253): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgccaccttgcgcagtggcaacctaattgttcggtccctatgacaattatagttacggtaccganagaacgccgagggtactccctaccccgtagtttcctccgtggtacggttcacggtacaaactcgaagaactaaacgacgagggtctcgtacggaccgttaccccgacgtcccgtactttccgtacgtacgggtaacccctaccggtaaaggtacgttacgtaacccgtttacccccggaaacccgtaaccgggccggttaaacggggtaaacttttaaaccgttaaccgttacttaaacgttcccgtttcgggtaccgggttaccccttaccggtaacggtttcccgtaaggggtaaaccgtaaggtttcggggaacgggttacccttagggttaaaccttttacgttttaacccgggttttggggttttaaccggtaacgtttccgggaaacctaaacgtaaacccggtaccgtcgttacgggtacttacccggtcgggtaacccggttcgggaaacccgtccggttccgtaaccggttcgtacgggcaacccggaccaacccgccctaacccgtaagtcgtccacgtttccttcccgtaacccc

SEQ ID NO: 403353 - DNA, 611 bp, Homo sapiens
  misc_feature: GZ8MTXP01D19XE.13.11.A11.1.454.CMB.2.raw
  modified_base (249)..(249): a, c, t, g, unknown or other
  modified_base (268)..(268): a, c, t, g, unknown or other
  modified_base (590)..(590): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgctaccttgcgcagtggcaccctaattgttcggtccctatgactatatagttcggacanagaagccgagggactcccncctagttctccgtgtacgttcagtacaaactcagaataacgacgagggactcgtacggacctcccgagtcccgtcttctcgtaggacctaccgaaagcgtagtaccgttacccgacctaacggcgtaaagggtactaacttactacgtacttctccgtgggaccttacccgaagtccttaggacgtagttcggaaggtcctagaactttaattacgttggggtttcgacgttacggacaacgaactacgcgtagtactcgttacgacgtggaacgtcgttacctacgttcgtaacgcacgcccgacgccctaaccctcgtcnccttacctccgttccgtcccg

SEQ ID NO: 403354 - DNA, 665 bp, Homo sapiens
  misc_feature: GZ8MTXP01DOBLN.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttgtccctatgactatatagttggtaccgacaggaacgccgagggactccctcccctagtttctcctgtaggttcaggtacaaactcaagaactaaaacgacgacgggctcgtacggaccgtccccgacggtccgtctttctcgtaggtacctaccgaaggtatcgtaccgttacccgaccgaaccgacgaagggtaacttacttacctctacttctccggtcgggtcctaccgaagtcgttacggaacgtagtaggaacgtcgtacgttaacttagtttaaccgtttgggttttacgacgtttacggacctaaacgaaccgtaacgtccgtaggtacctcgttaccggaccgtcgggaacccgacggttccgacccgttcgtacggtcaaccgcccgaacccggaacccaaccccgtaacgtcgtaccttaccttccttccgttaaccccccg

SEQ ID NO: 403355 - DNA, 713 bp, Homo sapiens
  misc_feature: GZ8MTXP01BCQ1H.13.11.A11.1.454.CMB.2.raw
  modified_base (242)..(242): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacatgttcgtcctatgactatatagttggtaccganagaagccgaggggtactccctccccgtagtttcctccgtggtaggttcaggtacaaactcgaagaactaaacgacgacgggtctcgtaggaccgttcccaggccgtcttacgtcgtcggaccttaccgaaaggtctacgtaccttcccggacctaacgggcgaaaggggtacttaacgtaccgtacgtaattccgtcgttcgggtaccttacccggaacggtttccgttacgggaaccggtagttaacggggtacggtaccttacggtaaccttttaagtttaacccgtttggggtttaacgtaccgtttacggaccgttaaaccgaaacgtaaccggtctacgggttacttccggtaccggtaccgtcgggaaccctcggttccgtacccgttcgtaacgggtccaacccggcccgttaacggaacccctaacccgtaacgtcctaccttacctccgtttcgtaaccccc

SEQ ID NO: 403356 - DNA, 613 bp, Homo sapiens
  misc_feature: GZ8MTXP01AJHN8.13.11.A11.1.454.CMB.2.raw
  modified_base (191)..(191): a, c, t, g, unknown or other
  modified_base (220)..(220): a, c, t, g, unknown or other
  modified_base (236)..(236): a, c, t, g, unknown or other
  modified_base (538)..(538): a, c, t, g, unknown or other
  modified_base (590)..(590): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctctatgagttgactcagccaccctccatcgtccgtgtccccccgganagacagccctacatccacctgctctgganatgtattgactaacgngtatggttcctggtatcagcaggaagcacggccacgccccctgtcctactcatcttacaaaactcgaggtccgccctcgtcggggtaccctgagtcgtactccgtccccggctccgcctcgtacggggaaaacctcgtaacgtccaaccgtctacggaccctattccgaacgggcccggaacccgtacgcccgttaagttcggtatacggtacggtcgttaacggttcttaacgttccgagttcgaacgggggtcggtacggggtacaacgtagtcgtcgcgttcgtcgggcggtacggcgngtcgtcgaccgttcgttacggtcacgcccgaggcctccgcccgtcggtaccncggttcctcgttcccctaacccg

SEQ ID NO: 403357 - DNA, 410 bp, Homo sapiens
  misc_feature: GZ8MTXP01DFM9M.13.11.A11.1.454.CMB.2.raw
  modified_base (259)..(259): a, c, t, g, unknown or other
  modified_base (334)..(334): a, c, t, g, unknown or other
  modified_base (360)..(360): a, c, t, g, unknown or other
  modified_base (377)..(377): a, c, t, g, unknown or other
  modified_base (395)..(395): a, c, t, g, unknown or other
  modified_base (398)..(410): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctagaagtattttgctagtatattcctgtcacctagtttggngactcaacgtggacgtcggaccagtcgggaaccgaaggtggaaatagaaacgactgtaggctgcacatctgtctnactcctccgcatcctagatagtacgngaactggaacgcgggtntagggacaagggcgatanagnnnnnnnnnnnnn

SEQ ID NO: 403358 - DNA, 700 bp, Homo sapiens
  misc_feature: GZ8MTXP01EGYS1.13.11.A11.1.454.CMB.2.raw
  modified_base (239)..(239): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtcctatgacatatattggtaccanagagcgaggagtcctccccagttctctgtagtcaggtacaactcagataaacgacgagggactcgtggacgtccccgagtccgcttcgtcgtggaccctccgaaagggtatcgtaacgttacccgaccgaacggcaaaggggtactaacttactcagttccctgtcgggtcctcggtagttccgtaggtaacgtaatggtaacgggccttaagtaactttaagtttaaccgttgggttttacgtaaccgtttagggacctaaaccaaacgtaaaccccggtccgttacggggtactttacccggttaccggggtaacccgttcgggggaaccccgttaccgggttaccgttaccccgttaccggttacgggtaacccgacccggttaccccgaaaccgggaaccccccaaaccccgtaacggttccgtacccaccgttcccttccccgggttttccccccg

SEQ ID NO: 403359 - DNA, 645 bp, Homo sapiens
  misc_feature: GZ8MTXP01ATJVN.13.11.A11.1.454.CMB.2.raw
  modified_base (242)..(242): a, c, t, g, unknown or other
  modified_base (424)..(424): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttcgtcctatgacatatagttggtaccganagaagccgagggacgtccctcccctagttctcctgtaggttcaggtacaactacagaataaacgacgaggtctacgtggacgtcccgcgaaaccgtcttctcgtggtacctcgtaaggagtcgtacttacccgaccaacgcgaagggtatacttactcgatcgtcgtgggctcgacgttcgnggtaacgagtagtaaggcttagtaacttagtttaacttggggtttacgtacgttagaccgtaaacaaacgaccgtacgtacgtacgttccgttaccggacccgtacgggaacccgtacggttacccgtacccgttccgtaacgggttccaccggaccccgttaaccgggaacccccacccgtaaccggttcctaccttacctccgttaacccgtttccccc

SEQ ID NO: 403360 - DNA, 721 bp, Homo sapiens
  misc_feature: GZ8MTXP01BJRRD.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcgcagtggcaccaattgttgtccctatgactattatattcggtaccgacagacgccgagggactccctccctagtttcctccgtagtacggttacacggtacctaaaactaccgaagtaacgtaaacggacgtacgggtacttcgtacgggacccgttaccccgacgtcccgtactttccgtcggtacgaaccttacccgaaagggtactacggtaaccgttccccgaacccgaacggtacggtaaaggggtactttaaacgtaaccttacgtaacgttccctacggttcggggccttacccgaagttcccgtaggaaccgtagtacgggacgtacgtaaggttaccttaagtttaccgttggggtttagtaccggtttaggacaaaccgtaacaccgggtctaggttactccgttacggtccgtacgggaacctaaccggcgtacccgttagtacggtccaccggttcccaacggaaccccaaccctcgtacgtccttaccttcgttaacccgtttcccccg

SEQ ID NO: 403361 - DNA, 730 bp, Homo sapiens
  misc_feature: GZ8MTXP01D36M8.13.11.A11.1.454.CMB.2.raw
  modified_base (245)..(245): a, c, t, g, unknown or other
  modified_base (499)..(499): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttcgtccctatgactatatagttaggtaccganagaacgccgagggactccctcccctagtttcctccgtaggtacggttcaggtacaaactcaagaactaaacgacgaagggtctcgtacggaccgtccccgagccgtctttactcgtacggtactacccgaaaggtacgtacgtaccgttaccccggaaccctaacggaccgtaaacgggggtaactttaacgttacctcgtaacgttccgttcggttcggggaccttcccgtaaggttccgtaggtaaaccggngttacgggagggtacttaggtaactttagtttaaccgtttggggtttacgtaaccgtttacgggaaccctaaaccgtaaacgtaacccgtccggttaggtaccgttaccgtaccggggtaccgttaccgggaaccctacggttccgtacccgttcgtaacggtccgaacgccccgttaaacggaacccctaacccaacgttcgaccttaccttccgttcccgttaaccccc

SEQ ID NO: 403362 - DNA, 623 bp, Homo sapiens
  misc_feature: GZ8MTXP01C8MI7.13.11.A11.1.454.CMB.2.raw
  modified_base (595)..(595): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgactatatattggtaccgacagaagccgaagggtactccctcccctagtttcctccgtagaggttcaggtacaaactcaagaataaacgacgagggctcgtaggacgtccccagtccgcttctcgtggacctccgaaaggtatcgacttcccgaccaacggcgaagggtattacttaacctctaagttcctacgttcggggacctaccgtaggtcctagacgtagtggacgtctagtaacttattacgttggtttacgacgttgacaacgaaacgacgtccgtaggtacttccgttacggaccttggggaaccctacggttccgaccgttcgtaaggtcaaccggcccaaacgggtccccaaaccccgtntacgtaccttaccttccgttccgtcccc

SEQ ID NO: 403363 - DNA, 718 bp, Homo sapiens
  misc_feature: GZ8MTXP01BEM5V.13.11.A11.1.454.CMB.2.raw
  modified_base (181)..(181): a, c, t, g, unknown or other
  modified_base (203)..(203): a, c, t, g, unknown or other
  modified_base (374)..(374): a, c, t, g, unknown or other
  modified_base (693)..(693): a, c, t, g, unknown or other
tcagtcacgtactacacgaccggtgctcgatttagctacgactgcaggggagcttcagctgtggtagagaagacaggattcaggacaatctccagcatggccggcttccctctcctcctcacccctcctcactcactgtgcagggtcctgggcccagtctgtgctgactcagcccaccctnagccgtcgtcgggacccccggnagagtcgtccaccattctcgtttgttcgtagggaggctaggtcgacccaaacgtagtccggggtaagttaattatggactatttcgaggtactaccaaacctaacctccccgaacggaaccccggtcccccagtacctccgtacacttctaataagacctaaataacccgnggacccggccctacggacggggtcccctaggacccccgtatttcctgtcggccctaaaccctaagtcccgtgggacccaccccttcgacccgtcccttccccgacggcctaactccgtagggtacgggtcccgtccccgggtacggacgtacgtggaaacggtcctaggtactttaacgttacgtcgttacgagtccggttaggagtaccgactacgtacctagtaacgtttaccggtttcgggggtttaacggcgggttaacggtaccgttaagtccggacccgttaccgttagttccgaaccggtaccaacggtccncccggttcccctgttcccgtaaccg

SEQ ID NO: 403364 - DNA, 443 bp, Homo sapiens
  misc_feature: GZ8MTXP01AH0MY.13.11.A11.1.454.CMB.2.raw
  modified_base (390)..(390): a, c, t, g, unknown or other
  modified_base (429)..(443): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctagaagtactttgacttacttttattctgtacacctagttagtggtacggtcaccgtactacgttttcggaccgtaggggacccaaggcgtaggatatacgaaacgcgtaaacgtggtaggctacgcaccagtctgtccttcactcctcccgctatctagaatagtaccgtnaccgtgacgggcgggtcagggaccgaagggccagtagannnnnnnnnnnnnnn

SEQ ID NO: 403365 - DNA, 695 bp, Homo sapiens
  misc_feature: GZ8MTXP01ELUBT.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcgcagtggcacctaatgttcgtcctatgacatatattggtaccgacagagccgagggtacgtccctcccgtagttctccgtagtacggttcgtaggtacaaacgttcgaagaactaaacggacgagggtctcgtaggaccgttccccgacggtccgtcttcgtacgtggtacctaccgtaaaggtactgtaccgttacccgaccgaacggtacgtacgggtaacttacttacctactacttactcgtcggtcctaccgtagttccgtacgacgtacgtcggtaggtccttaggtaaccttatttaaccgttggggttttacgtacgtttacggaccaaacgtaaaccgaacggtccgtacggtacttaccggttaccggtaccggtacgggtaacccgtaacgggttccctaacccggttccgtacggtaccgaccgacccgaaccggaaccctaaccccgtcttacggccttaccttccgttcccgttaacccccg

SEQ ID NO: 403366 - DNA, 475 bp, Homo sapiens
  misc_feature: GZ8MTXP01DTNPU.13.11.A11.1.454.CMB.2.raw
  modified_base (194)..(194): a, c, t, g, unknown or other
  modified_base (457)..(475): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagactttnactctcaccatcagcagactggaaacctgaagtctttgcttacttttattctgtcacctagttagtggtaggtcaccgtactacttttggccgagggtaccaagcgtaggagatacgaagacgtaaacgtggtggcttgccaaccgattcgtgttccttccacgttccttccccgcctacttaccttagtaacgttacgttacggtagtaccgttggacgggtcggggtccgttagggaccgaaagggcggacaaaggttagnnnnnnnnnnnnnnnnnnn

SEQ ID NO: 403367 - DNA, 785 bp, Homo sapiens
  misc_feature: GZ8MTXP01AQ01I.13.11.A11.1.454.CMB.2.raw
  modified_base (263)..(263): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgccaccttgcgcagtggcaccaattgttcgtccctatgactatatagttggaccagagagcgagggactcccnccctagttcctcgtagtacggttcaggtacaaactcaagaactaaaccgacgacgggtctacggtcggacccgtccccgaacggtcccgtcttaccgtcgtacggacccttaccggaaaggtacgtacgtaccgttacccgaacccgtaacggtacggaaacgggtaaacttactttaaccctactaacgttccgttcggtcggggtacctaccgtaacggttcgtaggaaaccggtagttcggacgggtcttacgtaacgtttacgtttacggttagggtttacgtacggttaccggacctaaaccgaaccgtaaccggtccgttaacggtcgttacccggttacgggaacccggtttaggggaaccccgtcccggggttaccccgtacccgtttaacccgggaccggttaaccccgaacccgggttaccccgaaacccggggtaacccccaaaccccccggttcggtttaccccgaacccgttacccctttaacccccggtttcccgtttaacccccccc

SEQ ID NO: 403368 - DNA, 569 bp, Homo sapiens
  misc_feature: GZ8MTXP01DORCE.13.11.A11.1.454.CMB.2.raw
  modified_base (253)..(253): a, c, t, g, unknown or other
  modified_base (292)..(292): a, c, t, g, unknown or other
  modified_base (319)..(319): a, c, t, g, unknown or other
  modified_base (337)..(337): a, c, t, g, unknown or other
  modified_base (354)..(354): a, c, t, g, unknown or other
  modified_base (371)..(371): a, c, t, g, unknown or other
  modified_base (544)..(544): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatagtggtacacagagcagggactccnccctagttctctgagtcaggtacaactcagaataaacgngaggctcgtggacgtcccagcctactntcgtggactccaaaggtntacgactaccgacaagngaagtactactactctntctcgtagcctcgtagtcgtagaacgtagtgacgtctacgtaacttagtttacgtttgggttacgtacgttacgaaccaaacgaacgtaccgtcgtagtacttcggtaccggaccgtcgggaacctacggttaccaccggttcgtacgacaccgccgaacgtaacccaccgtntacgtccacttccgttcgtaacccc

SEQ ID NO: 403369 - DNA, 565 bp, Homo sapiens
  misc_feature: GZ8MTXP01A34YY.13.11.A11.1.454.CMB.2.raw
  modified_base (409)..(409): a, c, t, g, unknown or other
  modified_base (416)..(416): a, c, t, g, unknown or other
  modified_base (424)..(424): a, c, t, g, unknown or other
  modified_base (434)..(434): a, c, t, g, unknown or other
  modified_base (458)..(458): a, c, t, g, unknown or other
  modified_base (544)..(544): a, c, t, g, unknown or other
  modified_base (552)..(552): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgctttctccgtggagcgtcagccagtctcacctgcaccttgcgcagtggcaccaatgttcggtccctatgactattatagttgggtaacccgacaaggaacgccgaggggactccctcccctagtttcctccgtgtacggttcaggtacaaactcaagaactaaacgacgtagggctcgtggacgtccccgagcccgtcttcgcgtaggacctccgaaaggtctgacttaccgacaacgcagggatactacncatcctntcggctcngtctgaacgntgacgctgactattactgggtttnaacttggacaacgaacacgcgtaggtactccgtcgacctgggaacctacggcctacgttcgtaaggcacgcccaaggccccaaccntcgtaccncctcgttcctccc

SEQ ID NO: 403370 - DNA, 452 bp, Homo sapiens
  misc_feature: GZ8MTXP01BPBSH.13.11.A11.1.454.CMB.2.raw
  modified_base (430)..(452): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagtacttcactctcaccatcagcagactaggaacctgaaacgtactttgacttacttttatttctgtcacctagtatggtagtcacgtactacgtttggaccgtacggggaccaaggtcgaggagatacgaagcgaagtgtaggctagcacctatctagtcttctacttcctcccgctactcctagtaacgtacgtaccgtgacgtaggacgggcgggtactcgggacgaagggccagagtagnnnnnnnnnnnnnnnnnnnnnnn

SEQ ID NO: 403371 - DNA, 755 bp, Homo sapiens
  misc_feature: GZ8MTXP01ADPTU.13.11.A11.1.454.CMB.2.raw
  modified_base (258)..(258): a, c, t, g, unknown or other
  modified_base (286)..(286): a, c, t, g, unknown or other
  modified_base (306)..(306): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcgcagtggcacctaatgttggtccctatgacatatatggtaccacagagcgaggactccncccagttctcctgtgtacagtacaactnagaataaacgacaggctcgngtaccgtcccagccgtcttcgctggactcaaggtatacgtactaacccgaccgaacgcgtaacgggattactacctacagtccgtacgttcgggaccttccgaacggttccgtacggacgtagttacggaagggtcttaaccgggttaacttaaaccgttttcgttaagggggttttacggtaacggtttacccgggtaacctaaaacccgtaaacccgaaaccgggttccccgttaaggggttaaccgtttaccccgggttaccgggggtaaaccccgttcccgggggaacccgtaacccggggttccccgtaccccgggttaaacccggttaccgggggtaacccttaccgggggaacccccttaaaccgggggtaacccccaacccccgggttaacttaccggtaacccgttaccccgttcccgttaacccgttttaacccccccg

SEQ ID NO: 403372 - DNA, 725 bp, Homo sapiens
  misc_feature: GZ8MTXP01B9W4I.13.11.A11.1.454.CMB.2.raw
  modified_base (247)..(247): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaaccattgttcggtccctatgactatatagttggtaccganagacgcgaggactccctccctagttctcgtagtaggtcaggtacaactcaagaacgtaaacgacgagggtctcggtaggacccgtccccgagtccgtcttcgtcgtcggactaccgaaggtcgtacgtacgtaccccgacgaacggtcgaaagggtacttacttactctattcccgtcggtacgggtcctacgcgttaccgaggtaccgtagtcgggacgtcgttagtaactttcgtttaacgttggggtttaacggttacggttacggaacctaaccgtaaaccgaccgtccgttaggtaaccgttccgttacccgggaaccggtccggggtaaccccgtaaccgggttcccgtaccccgggttaccgttaaccggggttcccgaacccgggttaccccgttaacccggtaacccctacccccgtaacgtttcccggtacccttaccggtttcccctttcccggtttaacccccccg

SEQ ID NO: 403373 - DNA, 595 bp, Homo sapiens
  misc_feature: GZ8MTXP01ASSF4.13.11.A11.1.454.CMB.2.raw
  modified_base (244)..(244): a, c, t, g, unknown or other
  modified_base (256)..(256): a, c, t, g, unknown or other
  modified_base (288)..(288): a, c, t, g, unknown or other
  modified_base (359)..(359): a, c, t, g, unknown or other
  modified_base (440)..(440): a, c, t, g, unknown or other
  modified_base (478)..(478): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcttgggttttccttgttgctattttaaaaggtgtccagtgtgaggtgcagctggtagagtcgtgggggagtgtgggtacggccgtgggggtccctcngactctcctgtncaacctctggattcagtatttgatgagtacgnggacagtacacgtggtccccacgaaccgtccgaggggacgggctgcgtagtcggtctctaggtaataacgngtaactggtgacagcaaactaacttgtcgcagtactcgtgtagaaacggggccctaattaccacctaattccacgaagganacgagtcgaccgaagtaaccgtcgaacattaccgtaanaactaaagagacgacgtcgtacggtacgtacggacgacgtaacgtcgttgttcgttcgtggtggttacggttggttacgtgtaggtcggtcgtacggttacgtaacgttaacgtaag

SEQ ID NO: 403374 - DNA, 596 bp, Homo sapiens
  misc_feature: GZ8MTXP01BYLU7.13.11.A11.1.454.CMB.2.raw
  modified_base (192)..(192): a, c, t, g, unknown or other
  modified_base (201)..(201): a, c, t, g, unknown or other
  modified_base (351)..(351): a, c, t, g, unknown or other
  modified_base (376)..(376): a, c, t, g, unknown or other
  modified_base (455)..(455): a, c, t, g, unknown or other
tcagtcacgtactacacgaccggtgctcgatttagctacgactgcaggggggaagagctgctcagttaggacccagagggaaccatggaaacccagcgcagcttctcttcctcctgctactctggctccagataccacggagaaattgtgttgacgcagtctccaggcatcgtgtctttgtctcgagggaanagccacctntcctgcagggccagtcagattgcagcagcaactacttagcctggtaccagcagaagtctcgggcccggccccaggcctcctacatcctacgatgtattcgaaggacgacctacgtgaacactcccagacacgttcagtgccaggtggtcnggacaagacttcactctcacatcancagactaggactgaaatatttgcttaatttgttcagtacaacctagttacgtaggtaaatggttcgacttcgacccaanaacggtttcctaggtttacctttccggaaacttttccccggttacccccgttactaacgttccgttaaagttaaacgttaccggttacgacgtaaccgtagggtaacggtacgggtcggttacggtaacggaacggtaacg

SEQ ID NO: 403375 - DNA, 388 bp, Homo sapiens
  misc_feature: GZ8MTXP01AP2DC.13.11.A11.1.454.CMB.2.raw
  modified_base (216)..(216): a, c, t, g, unknown or other
  modified_base (225)..(225): a, c, t, g, unknown or other
  modified_base (255)..(255): a, c, t, g, unknown or other
  modified_base (310)..(310): a, c, t, g, unknown or other
  modified_base (316)..(316): a, c, t, g, unknown or other
  modified_base (339)..(339): a, c, t, g, unknown or other
  modified_base (354)..(354): a, c, t, g, unknown or other
  modified_base (360)..(360): a, c, t, g, unknown or other
  modified_base (377)..(388): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggancctgaagtnttttgcagtatattcctgtcactagtttgnactcaacgtggacgtcggcctagtgggaccaagggtgaaatcgaaagactgtggntgcacntctgtctcattcctccgcatctnatagtactgataggngcgggntggcaaggctcgaatgnnnnnnnnnnnn

SEQ ID NO: 403376 - DNA, 545 bp, Homo sapiens
  misc_feature: GZ8MTXP01E46JH.13.11.A11.1.454.CMB.2.raw
  modified_base (522)..(522): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttggtccctatgacatatattggtaccgacagaagccgagggactccctccccagtttctcctgaggttcaggtcaaactcagataaacgcagggctctggacgtccccagccgtcttctcgtggactaccgaaaggactgacttacccgccaacgcgaagggattagttactcatctcgtgggcctccgagtctgacgatgaggctgacttatacttggttgacgttgacacaaacacgtccgtaggatccgtacggacctgggaaccacggttcacccgttcgtacggtcacgcccacggcccacccnctcgtcacttccgttcgttcccc

SEQ ID NO: 403377 - DNA, 495 bp, Homo sapiens
  misc_feature: GZ8MTXP01CTM00.13.11.A11.1.454.CMB.2.raw
  modified_base (220)..(220): a, c, t, g, unknown or other
  modified_base (345)..(345): a, c, t, g, unknown or other
  modified_base (475)..(475): a, c, t, g, unknown or other
  modified_base (479)..(495): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggcacctccaacagggccactggccgtcccagacaggttcacgtgggcggtgggtctgcgacaaacttcactctcaccgtcaccagactggacnctagaagtattttgactagtattacttcctgtacaccgttaggttggactactcggaaacgttgggaccgttcggccgagtacgggaaccgtaaagggtaggaaaataggaaaaccggttaaacncggttggtactcggacccaaccgtatttccgtcgttccttactaccttacccgttcccgactacggttccagtagtaacgtcccggtaggaccgtggacgggtccgggagtacggcgaaagggccagtanacgnnnnnnnnnnnnnnnnn

SEQ ID NO: 403378 - DNA, 472 bp, Homo sapiens
  misc_feature: GZ8MTXP01CPVV8.13.11.A11.1.454.CMB.2.raw
  modified_base (443)..(472): a, c, t, g, unknown or other
tcagtcacgtactacacgaccggtgctcgatttagctacgactgcagggccagtcagattgtcagcagcaactacttagcctggtaccagcagagcctggccaggcccccaggcctcctcatctacgatgtattcaggagaccatgacatcccagacaggttcagtggcaggtgggtctgggacagacttcactctcaccatcagacagtaccgtaggaaaccctagaaacgtacttttgaccttaattttttactttccgtagtacccaaccgttaagtacgttacgggtaactggttacggccttcggacctaacccgttattcccttacgtttaccttctaccctttcccgttccccacttacgttctaggtattaacgggtttctacggtcgttagggaccgggcggtcgtaaccgggcgaaacggtcgactaaggtannnnnnnnnnnnnnnnnnnnnnnnnnnnnn

SEQ ID NO: 403379 - DNA, 378 bp, Homo sapiens
  misc_feature: GZ8MTXP02JCP9G.13.11.A11.1.454.CMB.2.raw
  modified_base (339)..(339): a, c, t, g, unknown or other
  modified_base (375)..(378): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtagtcaccgtacactttggccaggggaccaagctggagatcaagcgaactgtggctgcaccatctgtcttcatcttcccgcatctgntagtacgtgactgagcgggctggcaaggcgcatagnnnn

SEQ ID NO: 403380 - DNA, 377 bp, Homo sapiens
  misc_feature: GZ8MTXP02GFD7Y.13.11.A11.1.454.CMB.2.raw
  modified_base (338)..(338): a, c, t, g, unknown or other
  modified_base (374)..(377): a, c, t, g, unknown or other
tcagtcacgtactacacgaccggtgctcgattagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtagtcaccgtacactttggccagggaccaagctggagatcaagcgaactgtggctgcaccatctgtcttccatcttccgccatctgntagtacgtgactgagcgggctggcaaggcgcatagnnnn

SEQ ID NO: 403381 - DNA, 378 bp, Homo sapiens
  misc_feature: GZ8MTXP02FXH2R.13.11.A11.1.454.CMB.2.raw
  modified_base (341)..(341): a, c, t, g, unknown or other
  modified_base (376)..(378): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagtactggaacctgaagactttgcactttattctgtcaccagtatggtaggtcaccgtacacttttggccaggggaccaagctggagatcaagcgaactgtggctgcaccatctgtcttcatcttccgcatctgntagtactgactgagcgggctggcaaggcgcatagnnn

SEQ ID NO: 403382 - DNA, 484 bp, Homo sapiens
  misc_feature: GZ8MTXP02F1H4I.13.11.A11.1.454.CMB.2.raw
  modified_base (196)..(196): a, c, t, g, unknown or other
  modified_base (407)..(407): a, c, t, g, unknown or other
tcagtcacgtactacacgaccggtgctcgatttagctacgactgcagggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaanagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagcttcactctcaccatcagcagactggaacctgaagactttgctactttattcngtcacagtatgaactgtgctgcacatctgtctcatcttccgcatctgactgtacgtgactgacgcgggctggcaagg

SEQ ID NO: 403383 - DNA, 604 bp, Homo sapiens
  misc_feature: GZ8MTXP02JK97I.13.11.A11.1.454.CMB.2.raw
  modified_base (352)..(352): a, c, t, g, unknown or other
tcagtcacgtactacacgaccggtgctcgatttagctacgactgcagggctgggcctcaggaggcagcatcggaggtgcctcagccatggcatggatccctctcttcctcggcgtccttgcttactgcacagaatccatggcctcctatgagttgactcagccaccctccatgtccgtgtccccggacagacagcctacatcacctgctctggagatgtattgactaacgagtatggttcctggtatcagcagaaggcaggccagccccctgtccctatcatctttacaaaataccaggcgccctcgtggggtccctgagcgattctccccggctccgcctctgggaacacngtcactctgaccatcacgccggggaccccacgtaccttagtagagtaggacgtcgttcgtaccttcttcgtcgtacggacggtcgggtacggaaccagacgtcggtcgtcgttcggggtcgggacggggaaccgggccgtacggtcgtaccggtaccgttacggttacgggtacgacccgaccggaacggtccgccccgtcccccggttaccggtacctaccgttccgtttccccggtcccccgttaccccg

SEQ ID NO: 403384 - DNA, 389 bp, Homo sapiens
  misc_feature: GZ8MTXP02H229V.13.11.A11.1.454.CMB.2.raw
  modified_base (346)..(346): a, c, t, g, unknown or other
  modified_base (383)..(389): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcaagcgaactgtggctgcaccatctgtcttcatccttcccgcctatctgntagtacgtgactgagcgggtctggcaaggcgcatagnnnnnnn

SEQ ID NO: 403385 - DNA, 508 bp, Homo sapiens
  misc_feature: GZ8MTXP02G88TC.13.11.A11.1.454.CMB.2.raw
  modified_base (344)..(344): a, c, t, g, unknown or other
  modified_base (367)..(367): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacaggctctggacgtccccagcccgcttctctggactccaaggntgatccgcacgcaggatattacncatctctggctccagtctgacgatgaggctagactattactgtttgactttggcacaacaacgcctaggatcgttcggactgggaccacggtcaccgtcaggtcacgcccaaggcccaacccactcgcactctcgttcccc

SEQ ID NO: 403386 - DNA, 388 bp, Homo sapiens
  misc_feature: GZ8MTXP02HDAU3.13.11.A11.1.454.CMB.2.raw
  modified_base (344)..(344): a, c, t, g, unknown or other
  modified_base (375)..(375): a, c, t, g, unknown or other
  modified_base (381)..(388): a, c, t, g, unknown or other
tcagtcacgtactacacgaccggtgctcgatttagctacgactgcagggccagtcagattgtcagcagcaactacttagcctggtaccagcagaagcctggccacggcccccaggcctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtactactttggccaggggaccaagctggagatcaagcgaactggtgctgcaccatctgtctcatcctcccgcatctgntacgtacgtgactgagcgggctggcaaggcncatagnnnnnnnn

SEQ ID NO: 403387 - DNA, 383 bp, Homo sapiens
  misc_feature: GZ8MTXP02IBFB7.13.11.A11.1.454.CMB.2.raw
  modified_base (354)..(354): a, c, t, g, unknown or other
  modified_base (365)..(365): a, c, t, g, unknown or other
  modified_base (379)..(383): a, c, t, g, unknown or other
tcagtcacgtactacacgaccggtgctcgatttagctacgactgcagggccagtcagattgtcagcagcaactacttagcctggtaccagcagaagcccggccaggcccccaggctcctcatctacgatgtattcaggaggaccactgacatcccagacaggttcagtggcagtgggtctgggacagacttcactctcaccatcagcagactggaaacctgaagactttgcacttttattctgtcaccagtatggtagtcaccgtacacttttggccaggggaccaagctggagatcaagcgaactgtggctgcaccatctgtcttcactccttccccgcatctgatgtacgtnactgagcgggntgcaagcgcatagnnnnn

SEQ ID NO: 403388 - DNA, 380 bp, Homo sapiens
  misc_feature: GZ8MTXP02G55QZ.13.11.A11.1.454.CMB.2.raw
  modified_base (339)..(339): a, c, t, g, unknown or other
  modified_base (375)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacactttggccaggggaccaagctggagatcaagcgaactgtggctgcaccatctgtctcatcttccgcatctgntagtacgtgactgagcgggctggcaaggcgcatagnnnnnn

SEQ ID NO: 403389 - DNA, 385 bp, Homo sapiens
  misc_feature: GZ8MTXP02H79X8.13.11.A11.1.454.CMB.2.raw
  modified_base (327)..(327): a, c, t, g, unknown or other
  modified_base (359)..(359): a, c, t, g, unknown or other
  modified_base (382)..(385): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgttcggccatgggaccaaggtggaaatgaaacgaactgtggctgcaccatctgtcttnatcttcccgcatcctgactagtacgtgactgngcgggctgggcaaggcgcatagnnnn

SEQ ID NO: 403390 - DNA, 382 bp, Homo sapiens
  misc_feature: GZ8MTXP02G4WSC.13.11.A11.1.454.CMB.2.raw
  modified_base (341)..(341): a, c, t, g, unknown or other
  modified_base (377)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacactttggccagggaccaagctggagatcaagcgaactgtggctgcaccatctgtctcatcttcccgcatctgntagtacgtgactgagcgggctggcaaggcgcatagnnnnnn

SEQ ID NO: 403391 - DNA, 333 bp, Homo sapiens
  misc_feature: GZ8MTXP02F0DDF.13.11.A11.1.454.CMB.2.raw
  modified_base (329)..(333): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctactttattctgtcaccagtatggaactgtggctgcaccatctgtcttcatcttcccgcatctgatagtactgactgagcgggctggcaaggcgcatagnnnnn

SEQ ID NO: 403392 - DNA, 524 bp, Homo sapiens
  misc_feature: GZ8MTXP02F259L.13.11.A11.1.454.CMB.2.raw
  modified_base (378)..(378): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctcggactccgaaggatcgacttccgccaacgcagggactattacncatctctggctcagtctgacgatgagctgactattactgtttgacttggacacaacaacgcctaggatcgttcggaccttgggacccacgggtccaccgtctacggtcacgacccgaaggcccaacccactcgtccactcttcccg

SEQ ID NO: 403393 - DNA, 388 bp, Homo sapiens
  misc_feature: GZ8MTXP02IR9WW.13.11.A11.1.454.CMB.2.raw
  modified_base (383)..(388): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgacctgagcggggctgggcaaggcgcatagnnnnnn

SEQ ID NO: 403394 - DNA, 504 bp, Homo sapiens
  misc_feature: GZ8MTXP02H96A9.13.11.A11.1.454.CMB.2.raw
  modified_base (341)..(341): a, c, t, g, unknown or other
  modified_base (370)..(370): a, c, t, g, unknown or other
  modified_base (419)..(419): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaatcagataaacgacaggctctggagtccccagccgcttctctggactccaaggntgattccgcacgcaggatattactcatcnctggctccagtctgacgatgaggctgactattactgtttgacttggcanaacaacgcctggatcttcggactgggaccacggtcaccgtctaggtcacgcccaaggcccaacccactcgcactcttcgtccccc

SEQ ID NO: 403395 - DNA, 376 bp, Homo sapiens
  misc_feature: GZ8MTXP02GHM1N.13.11.A11.1.454.CMB.2.raw
  modified_base (336)..(336): a, c, t, g, unknown or other
  modified_base (365)..(365): a, c, t, g, unknown or other
  modified_base (371)..(376): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtagtcaccgtacactttggcaggggaccaagctggagatcaagcgaactgtggctgcaccatctgtcttcatctccgcatctgntagtacgtactgagcgggctggcaaggcncatagnnnnnn

SEQ ID NO: 403396 - DNA, 384 bp, Homo sapiens
  misc_feature: GZ8MTXP02FW3P1.13.11.A11.1.454.CMB.2.raw
  modified_base (242)..(242): a, c, t, g, unknown or other
  modified_base (345)..(345): a, c, t, g, unknown or other
  modified_base (381)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttcngtcaccagtatggtaggtcaccgtacacttttggccaggggaccaagctggagatcaagcgaactgtggctgcaccatctgtcttccatcttccgccatctgntagtacgtgactgagcgggctggcaaggcgcatagnnnn

SEQ ID NO: 403397 - DNA, 387 bp, Homo sapiens
  misc_feature: GZ8MTXP02GNF2N.13.11.A11.1.454.CMB.2.raw
  modified_base (346)..(346): a, c, t, g, unknown or other
  modified_base (383)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttccatcttcccgccatctgntagtacgtgactgagcgggctgggcaaggcgcatagnnnnn

SEQ ID NO: 403398 - DNA, 511 bp, Homo sapiens
  misc_feature: GZ8MTXP02G3WSR.13.11.A11.1.454.CMB.2.raw
  modified_base (329)..(329): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccttgagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttcnctggactccaaggatgattccgcacgcagggatattactcatctctgggctccagtctgacgatgaggctgacttattactgtttgacttggcacaacaacgcctggatcttacggactgggaccacggtcaccgtctacggtcacgcccaaggccaacccactcgtcactctcgttccccc

SEQ ID NO: 403399 - DNA, 531 bp, Homo sapiens
  misc_feature: GZ8MTXP02H57MD.13.11.A11.1.454.CMB.2.raw
  modified_base (228)..(228): a, c, t, g, unknown or other
tcagtcacgtactacacgaccggtgctcgatttagctacgactgcaggggagcttcagctgtggtagagaagacaggattcaggacaatctccagcatggcctggtctcctctcctcctcactctcctcgctcactgcacagggtcctgggcccagtctgtactgacgcagccgccctcagtgtctggggccccagggcagagggtcaccatctcctgcactggggancagctccaacattggggcacattatgatgtacactggtaccagcagtttccaggagcaggtccccagactcctcatacaaatagtaaacaaacaagtccggacccccgcgaacggggtcccctaggaccgtattctctgggctccaggtctcggcaccctcacgccctccctggtcatcacgtcggctccgaggctggaggatggagctgatttattctgccagtcctatgacacgcagcctgactcgtcgttcggtacgttcggggccgggggaccctacggcgtacggaccgtccgtacgg

SEQ ID NO: 403400 - DNA, 502 bp, Homo sapiens
  misc_feature: GZ8MTXP02I7M1A.13.11.A11.1.454.CMB.2.raw
  modified_base (196)..(196): a, c, t, g, unknown or other
  modified_base (205)..(205): a, c, t, g, unknown or other
  modified_base (353)..(353): a, c, t, g, unknown or other
  modified_base (493)..(493): a, c, t, g, unknown or other
tcagtcacgtactacacgaccggtgctcgatttagctacgactgcagggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaangccaccctntcctgcagggccagtcagattgtcagcagcaactacttagcctggtaccagcagaagctggccaggcccccaggctcctcatctacgatgtattcaggaggaccactgacatccccagacaggttcagtggcagtgggtctggggacngacttcactctcaccatcagcagactggaacctgaagactttgctactttattctgtcacctagtatggtaggtcaccgtacactttggctaggggtaccaagctggagagtcaagcgaactgtacggctagcacatctntctctactc

SEQ ID NO: 403401 - DNA, 515 bp, Homo sapiens
  misc_feature: GZ8MTXP02HWX58.13.11.A11.1.454.CMB.2.raw
  modified_base (462)..(462): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttcctcctgaggttcaggtcaaactcagataaacgacaggctcgtggactccccagccgcttctcgtggactccgaaggatgacttcccgacacgcagggatattactcatctctgggctcagtctgacgatgaggctgactattactgtttgacttggcacaacacgctaggacttcgttcggacctggaccncggtcaccgtctacgtcacgcccaagcccaacccactcgcacctctcgtcccc

SEQ ID NO: 403402 - DNA, 495 bp, Homo sapiens
  misc_feature: GZ8MTXP02JZS62.13.11.A11.1.454.CMB.2.raw
  modified_base (328)..(328): a, c, t, g, unknown or other
  modified_base (348)..(348): a, c, t, g, unknown or other
  modified_base (418)..(418): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtcattgcttactgcacagaatccatggcctcctatgagttgactcagccaccctccatgtccgtgtccccccggacagacagcctacatcacctgctctggagatgtattgactaacgagtatggttcctggtatcagcagaaggcaggccagccccctgtcctactcatcttcaaaataccaggcgccctctggggtccctgagcgattccnccggctccgcctctgggacncagtcactctgaccatcagcggacccagcctatgatgaggctgtctacttctgtcaggcgtgggacaacngcgtgcgtgtcggcggagggaccagtctgaccgtctacggtcacgcccaggctcgcccctcggtcactctcgtcccc

SEQ ID NO: 403403 - DNA, 384 bp, Homo sapiens
  misc_feature: GZ8MTXP02GZZ2L.13.11.A11.1.454.CMB.2.raw
  modified_base (343)..(343): a, c, t, g, unknown or other
  modified_base (379)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacactttggccaggggaccaagctggagatcaagcgaactgtggctgcacatctgtctccatccttcccgcatctgntagtacgtgactgagcgggctggcaaggcgcatagnnnnnn

SEQ ID NO: 403404 - DNA, 387 bp, Homo sapiens
  misc_feature: GZ8MTXP02IWVEE.13.11.A11.1.454.CMB.2.raw
  modified_base (348)..(348): a, c, t, g, unknown or other
  modified_base (384)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaaacctgaaagactttgcactttatttctgtcaccagtatggtaggtcaccgtacacttttggccaggggaccaagctggagatcaaagcgaactgtggctgcaccatctgtcttcatcttcccgccatcctgntagtactgactgagcgggctgggcaaggcgcatagnnnn

SEQ ID NO: 403405 - DNA, 490 bp, Homo sapiens
  misc_feature: GZ8MTXP02GR6L2.13.11.A11.1.454.CMB.2.raw
  modified_base (236)..(236): a, c, t, g, unknown or other
  modified_base (433)..(433): a, c, t, g, unknown or other
  modified_base (447)..(447): a, c, t, g, unknown or other
tcagtcacgtactacacgaccggtgctcgatttagctacgactgcaggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntactctggtatcagcagaagtcaggccagtcccctgtgctggtcatctatcaagatgccaagccggaccctcgagggactcccccctgagcgattctctgggcctccaaactcgtgggaacctcacgcccactctgaccatccagccgggacccaggctagtgatgaggctgactattactgtcgaggcgtgggacnggcagcactgcccncgtatgtctcggaactggaacgaggcacgtctaatcagacccg

SEQ ID NO: 403406 - DNA, 383 bp, Homo sapiens
  misc_feature: GZ8MTXP02HSIT9.13.11.A11.1.454.CMB.2.raw
  modified_base (343)..(343): a, c, t, g, unknown or other
  modified_base (378)..(383): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttattctgtcaccagtatggtagtcaccgtacactttggccagggaccaagctggagatcaagcgaactgtggctgcaccatctgtcttccatccttcccgcatctgntagtactgactgagcgggctggcaaggcgcatagnnnnnn

SEQ ID NO: 403407 - DNA, 545 bp, Homo sapiens
  misc_feature: GZ8MTXP02F9IGB.13.11.A11.1.454.CMB.2.raw
  modified_base (368)..(368): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacaggctctggacgtccccagccgcttctctggactccaaggatgattccgcacgcgagggatatacncatctctgggctcgagtctgacgatgaggctagacttattactgtttgacttggactaacaaacaacgtcctaggacttccgttacggaccgttacgggaccctacgggtcaacccgttcgtaggtccacgacccaaggcccaaacccctactcgtaccactccgtccgttcccccg

SEQ ID NO: 403408 - DNA, 504 bp, Homo sapiens
  misc_feature: GZ8MTXP02HGC1I.13.11.A11.1.454.CMB.2.raw
  modified_base (365)..(365): a, c, t, g, unknown or other
  modified_base (419)..(419): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttctctggactccaggatgatccgcacgcagggatatacncatctctggctccagtctgacgatgaggctgacttatactgttgtacttggcanaacacgctggatcttcgactggaccacggtcaccgtcacggtcacgcccaaggcccaacccactcgtaccactctcgttaccccc

SEQ ID NO: 403409 - DNA, 509 bp, Homo sapiens
  misc_feature: GZ8MTXP02GJVOH.13.11.A11.1.454.CMB.2.raw
  modified_base (271)..(271): a, c, t, g, unknown or other
  modified_base (328)..(328): a, c, t, g, unknown or other
  modified_base (342)..(342): a, c, t, g, unknown or other
  modified_base (367)..(367): a, c, t, g, unknown or other
  modified_base (374)..(374): a, c, t, g, unknown or other
  modified_base (491)..(491): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttcncctgaggttcaggtcaaactcagataaacgcaggctctggagtccccagccgcttcnctggactccaaggntgattccgcacgcagggatattacncatctcngggctcagtctgacgatgagctgactattactgtttgacttggactacaacacgcctaggactcgttcggacttcgggaccacggtcaccgtctaggtcacgccaacggccaacccnctcgcactctacgtcccc

SEQ ID NO: 403410 - DNA, 387 bp, Homo sapiens
  misc_feature: GZ8MTXP02I85I4.13.11.A11.1.454.CMB.2.raw
  modified_base (345)..(345): a, c, t, g, unknown or other
  modified_base (381)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcaccatctgtcttcatcttcccgccatcctgntagtacgtgactgagcgggctggcaaggcgcatagnnnnnnn

SEQ ID NO: 403411 - DNA, 335 bp, Homo sapiens
  misc_feature: GZ8MTXP02JE003.13.11.A11.1.454.CMB.2.raw
  modified_base (330)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtgctgcaccatctgtcttcatcttcccgcatctgatagtacgtgactgagcgggctggcaaggcgcatagnnnnnn

SEQ ID NO: 403412 - DNA, 485 bp, Homo sapiens
  misc_feature: GZ8MTXP02HRLIB.13.11.A11.1.454.CMB.2.raw
  modified_base (418)..(418): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtgctggtcatctatcaagatgccaagcggccctcagggactccccctgagcgattctctggctccaactctgggaactcagcccactctgaccatcagcggacccaggctagtgatgaggctgactattactgtcaggcgtggacngcagcactcgcccgctagtcgtcgtcggaactgggaaccaggtccacgtcctaacgtccagaccccg

SEQ ID NO: 403413 - DNA, 605 bp, Homo sapiens
  misc_feature: GZ8MTXP02IU6AG.13.11.A11.1.454.CMB.2.raw
  modified_base (303)..(303): a, c, t, g, unknown or other
  modified_base (378)..(378): a, c, t, g, unknown or other
  modified_base (485)..(485): a, c, t, g, unknown or other
  modified_base (543)..(543): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaggtgtccagtgtgaggtgcagctggtagagtcgtgggggaggtgtggtacggccgtgggggtccctcagactctcctgtgcaacctctggattcagtatttgatgagtatggcatacacgtgggtcccnccaacctccgaggggaagggctgcgaggtggtctcgtaggtaataaacgtggaatggtcgccagcaactaacttntgacagacctcgtggtacggaaacggggccctaattcccaacctagttccctacccgaaggacgacaggtcgacccgaagaacctccgttacattctagactaaaancgaaactagtcgtacgggagtacggaaggaccgtacggtcctttaggttactttcggnggttcgacggttaggttacgaacgtagggtcggtaccgtaggttaaccttacgacgtaaagg

SEQ ID NO: 403414 - DNA, 377 bp, Homo sapiens
  misc_feature: GZ8MTXP02HQBM5.13.11.A11.1.454.CMB.2.raw
  modified_base (320)..(320): a, c, t, g, unknown or other
  modified_base (339)..(339): a, c, t, g, unknown or other
  modified_base (366)..(366): a, c, t, g, unknown or other
  modified_base (372)..(377): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcaagcgaactgtggctgcaccatcngtctcatctccgcatctgntagtactgactgagcggctgcaaggcncatagnnnnnn

SEQ ID NO: 403415 - DNA, 531 bp, Homo sapiens
  misc_feature: GZ8MTXP02II7E4.13.11.A11.1.454.CMB.2.raw
  modified_base (336)..(336): a, c, t, g, unknown or other
  modified_base (362)..(362): a, c, t, g, unknown or other
  modified_base (410)..(410): a, c, t, g, unknown or other
  modified_base (430)..(430): a, c, t, g, unknown or other
  modified_base (445)..(445): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcaagaaggcaggccagccccctgtcctactcatctttacaaaataccaggccggcccctcgtcggggtccctgacgcgacttcnccccggctcccgctctacgggacacngtcactctgaccatcagccggaccagcctatgatgagctgtctacttntgtcaggcgtgggacaacgngcgtgcgtggtcggnggacggacgagtcgtacgtacgtacgtacggcacgaccgaacgccgtccgccccgtcgtccaccgttccgtccgttccccgtcccg

SEQ ID NO: 403416 - DNA, 537 bp, Homo sapiens
  misc_feature: GZ8MTXP02JAM3Z.13.11.A11.1.454.CMB.2.raw
  modified_base (179)..(179): a, c, t, g, unknown or other
  modified_base (199)..(199): a, c, t, g, unknown or other
  modified_base (352)..(352): a, c, t, g, unknown or other
  modified_base (449)..(449): a, c, t, g, unknown or other
  modified_base (474)..(474): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctnagcgtctcgggacccccggnagagtgtcaccatctcttgttctggagcagtgccaacatcggggataattatgcattctggtatcaacaactcccaggaccgccccagactcctcatctatacgcaaataacccagccggccctcgacggggtcccctagacccccgattccnctggctccgaagtcctggccacctcagccctcctgccatcagtcggcctccggtcgacgatgaggctgattattacgtgttcagtcgttggatgacngctgtaagttacgttgggtttcggnggtaggacctaagtcgaccgcctaggtcaacgcccgaagtccgtcgccccgtcggtcctaccg

SEQ ID NO: 403417 - DNA, 339 bp, Homo sapiens
  misc_feature: GZ8MTXP02F5I9F.13.11.A11.1.454.CMB.2.raw
  modified_base (333)..(339): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtggctgcaccatctgtcttcatcttcccgcatctgatagtacgtgactgagcgggctggcaaggcgacagtagnnnnnnn

SEQ ID NO: 403418 - DNA, 384 bp, Homo sapiens
  misc_feature: GZ8MTXP02FY57H.13.11.A11.1.454.CMB.2.raw
  modified_base (242)..(242): a, c, t, g, unknown or other
  modified_base (342)..(342): a, c, t, g, unknown or other
  modified_base (371)..(371): a, c, t, g, unknown or other
  modified_base (377)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattcngtcaccagtatggtaggtcaccgtacacttttggtcaggggaccaagctggagatcaagcgaactgtggctgcaccatctgtctcatcttccgcatctgntagtacgtactgagcgggctggcaaggcncatagnnnnnnnn

SEQ ID NO: 403419 - DNA, 521 bp, Homo sapiens
  misc_feature: GZ8MTXP02GOYR5.13.11.A11.1.454.CMB.2.raw
  modified_base (211)..(211): a, c, t, g, unknown or other
  modified_base (321)..(321): a, c, t, g, unknown or other
  modified_base (338)..(338): a, c, t, g, unknown or other
  modified_base (366)..(366): a, c, t, g, unknown or other
  modified_base (387)..(387): a, c, t, g, unknown or other
  modified_base (479)..(479): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttanacagctccgacaataggaactacttagcttggtaccaacagaaaccaggacagcctaccgaagttactctttactgggcgtctacccgggaatcccggggtcctgaccgnttcagtggcaggcggtntggggacagtactttcactctcacatcngcagtccttcaggctgaaagntggtgctagtttatacgtgtcagactaatattatatctctccttctcggacgttcgccgaaggacgagggtacgaatacgaaacgaactggngctcgcactatctgtctcactccttcccgactactctagtac

SEQ ID NO: 403420 - DNA, 502 bp, Homo sapiens
  misc_feature: GZ8MTXP02HJHXM.13.11.A11.1.454.CMB.2.raw
tcagtcacgtactacacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaacgccccaaactcatcatttatgaagtcatttatcggccctcaggatttctaatcgcttctctgctcagtctggcaacacggcctccctgaccatctctgggctccgaggctgaagacgagctgatttatactgctgctcatatgactggttctctgtggttcttcgggcggaggtaccaaaggtcgaccgtcctaagggtcacgaccccaaggcctcgccccttcgg

SEQ ID NO: 403421 - DNA, 372 bp, Homo sapiens
  misc_feature: GZ8MTXP02J5B1X.13.11.A11.1.454.CMB.2.raw
  modified_base (340)..(340): a, c, t, g, unknown or other
  modified_base (354)..(354): a, c, t, g, unknown or other
  modified_base (356)..(356): a, c, t, g, unknown or other
  modified_base (360)..(360): a, c, t, g, unknown or other
  modified_base (362)..(362): a, c, t, g, unknown or other
  modified_base (368)..(372): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtggtctgggacagacttcactctcaccatcagcagactggaaacctgaagactttgctactttattctgtcaccagtatggtaggtcaccgtacactttgccagggaccaagctggagatcaagcgaactgtgctgcaccatctgtcttccatctccgtccatcttgntagtacgtgctggngngcgngngagcgnnnnn

SEQ ID NO: 403422 - DNA, 591 bp, Homo sapiens
  misc_feature: GZ8MTXP02H7IXY.13.11.A11.1.454.CMB.2.raw
  modified_base (387)..(387): a, c, t, g, unknown or other
  modified_base (395)..(395): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgtaggctgtgctgactcagccgtcttccctctctgcttctcctggagcgtcagccagtctcacctgcaccttgcgcagtggcaccaatgttgtcctatgacatatattggtaccgacagaagccgaggggacgtccctcccctagtttcctcctgaggttcaggtacaaactcagaataaacgacagggctcgtggactcccagccgcttctcgtggactccccgaaaggatcgacttcccgacaacgcgagggtatattacncatctcgnggtctccgagtctgacatggagctagacttatacgttgtttgacgttggacaacgaacacgtcctaggactttccgttacggaccgtacgggaaccctacggtcctacccggtaccttagggcccaacggaccccgaacggaccccaaaaccccctgtaccgtaccctaccttccgtcccgttacccccgtccccg

SEQ ID NO: 403423 - DNA, 555 bp, Homo sapiens
  misc_feature: GZ8MTXP02H80Q1.13.11.A11.1.454.CMB.2.raw
  modified_base (337)..(337): a, c, t, g, unknown or other
  modified_base (352)..(352): a, c, t, g, unknown or other
  modified_base (377)..(377): a, c, t, g, unknown or other
  modified_base (382)..(382): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctccccagtttcctcctgaggttcaggtcaaactcaagataaacgacagggctcgtggacgtccccagccgcttcnctggactccgaaggntgattccgacacgcaggatattacncatcnctggctcagtctgacgatgagctgactattactgtttgacttggacaacaacaacgcctggtacttccgttcggaaccgtcggggacccacgggttccaaccgttccgtaacggtccacgaccccgaaacggccccaaacccgacgtcgtccaccgtccgttcgttccccccg

SEQ ID NO: 403424 - DNA, 335 bp, Homo sapiens
  misc_feature: GZ8MTXP02F3HEQ.13.11.A11.1.454.CMB.2.raw
  modified_base (327)..(327): a, c, t, g, unknown or other
  modified_base (333)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttattctgtcaccagtatggaactgtggctgcaccatctgtcttcatccttcccgcatctgatagtacgtgactgagcgggctggcaaggcncatagnnn

SEQ ID NO: 403425 - DNA, 386 bp, Homo sapiens
  misc_feature: GZ8MTXP02HLXTH.13.11.A11.1.454.CMB.2.raw
  modified_base (346)..(346): a, c, t, g, unknown or other
  modified_base (381)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttccatcttcccgccatctgntagtactgactgagcgggctggcaaggcgcatagnnnnnn

SEQ ID NO: 403426 - DNA, 510 bp, Homo sapiens
  misc_feature: GZ8MTXP02G76F1.13.11.A11.1.454.CMB.2.raw
  modified_base (368)..(368): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaaggatgattccgcacgcagggatatacnatctctggctccagtctgacgatgagctgactattactgtttgacttggcacaacaacgcctaggatcgttacggacctgggaccacgtccaccgtcctacggtcacgcccaagcccaacccgactcgcactctcgtacccc

SEQ ID NO: 403427 - DNA, 511 bp, Homo sapiens
  misc_feature: GZ8MTXP02GTCSZ.13.11.A11.1.454.CMB.2.raw
  modified_base (211)..(211): a, c, t, g, unknown or other
  modified_base (285)..(285): a, c, t, g, unknown or other
  modified_base (374)..(374): a, c, t, g, unknown or other
  modified_base (471)..(471): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttanacagctccgacaataggaactacttagcttggtaccaacagaaaccaggacagcctccgaagttactctttacnggcgtctacccgggatcccggggtcctgaccgattcagtggcaggcgggtctggggacagtactttcactctcaccatcagcagccttnaggctgaagatgtggctagtttatactgtcagactaatattatatctctcctctcggacgttcgccaagggaccagggtagaaatacaaacgactgnggctgcacgatctgtctcactccttccgctatctagtacg

SEQ ID NO: 403428 - DNA, 389 bp, Homo sapiens
  misc_feature: GZ8MTXP02JYRTI.13.11.A11.1.454.CMB.2.raw
  modified_base (346)..(346): a, c, t, g, unknown or other
  modified_base (385)..(389): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcgaagcgaactggtggctgcaccatctgtcttccatccttcccgcatctgntagtacgtgactgacggcgggctgggcaaggcgcatagnnnnn

SEQ ID NO: 403429 - DNA, 499 bp, Homo sapiens
  misc_feature: GZ8MTXP02GZEFZ.13.11.A11.1.454.CMB.2.raw
  modified_base (484)..(484): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagttctcctgaggttcaggtcaaactcagataaacgacaggctctggagtccccagccgcttctctggactccaagatgattccgcacgcagggatattactcatctctgggctccagtctgacgatgaggctgactattactgtttgattggcaactaacaacgcctggattcgtcggactggaccacggtcacgtcaggtcacgccagccaacccacncgcactctcgtcccc

SEQ ID NO: 403430 - DNA, 545 bp, Homo sapiens
  misc_feature: GZ8MTXP02I7VDR.13.11.A11.1.454.CMB.2.raw
  modified_base (331)..(331): a, c, t, g, unknown or other
  modified_base (345)..(345): a, c, t, g, unknown or other
  modified_base (375)..(375): a, c, t, g, unknown or other
  modified_base (394)..(394): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccagggatcctccccagtttctcctgaggttcaggtacaaactcagaataaacgacagggctctggacgtccccagccgcttcnctggactccaaggntgacttccgcacgcagggatatactcatcnctgggctccagtctgacgntgaggctagacttagttactgtttagacttgggacaacgaaacacgcctaggacttccgttacggaccgtgggaaccctacgggtccaacccggtctacggtccacgcccgaaacggcccaacccgactcgaccaccttctcgttaccccc

SEQ ID NO: 403431 - DNA, 502 bp, Homo sapiens
  misc_feature: GZ8MTXP02G82DS.13.11.A11.1.454.CMB.2.raw
  modified_base (391)..(391): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaaggctgattccgcacgcagggatatactcatctctggctcagtctgacgntgagctgacttattactgtttgacttggcaacaacacgctggatctcggactggaccacggtcaccgtcaggtcacgcccaaggccaaacccgctcgacactctcgtcccc

SEQ ID NO: 403432 - DNA, 383 bp, Homo sapiens
  misc_feature: GZ8MTXP02JW324.13.11.A11.1.454.CMB.2.raw
  modified_base (378)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagaccggaacctgaagactttgctactttattctgtcaccagtatggtaggtcaccgtacactttggccaggggaccaagctggagatcaagcgaactgtggctgcaccatctgtcttcatcttcccgctatctgatgtacgtgactgagcgggctggcaaggcgcatagnnnnnn

SEQ ID NO: 403433 - DNA, 645 bp, Homo sapiens
  misc_feature: GZ8MTXP02IXWI9.13.11.A11.1.454.CMB.2.raw
  modified_base (378)..(378): a, c, t, g, unknown or other
  modified_base (409)..(409): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtcccgtcgtcccccggacagacagcctacatcacctgctctggagatgtattgactaacgagtatggttcctggtatcagcagaaggcaggcccacgccccctgtcccctactcattctttacaaaactaccgaggccggccctcgtcggggtccctggacgcgtacttccgtccccggcctccgcctcgtacgggaaccacgngtcactctcgaccatcgacggccgggacccngtactagtgtagtaggcgtcttcgtccttactcgtacgtcggtacgggtcggtagaacacggcgtcgtcgtcggttcggggtacgggacggggtaaccggcgtacggttaccggtaccggttaccggtttacggttaaccggaccgtaccgggtaacccgtaccggtcccgtcccccggtccccggttccggtaccctcccgtttccccgtttccccggtacccccgtttcccccg

SEQ ID NO: 403434 - DNA, 576 bp, Homo sapiens
  misc_feature: GZ8MTXP02JSY2Y.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccagggacgtccctccccagttctcctgaggttcaggtcaaactcagataaacgacagggctcgtggacgtccccgagcccgcttcctcgtggacctccgaagactgtacttccgacacgcgagggatatactcatctcgtggcctcagtctgacgatggagctagacttattacttggtttcgacgttggaccaacaaacgacgccgtaggacttcggttaccggaccgttcggggaccctacgggtaccaccgggttctacgggtccacggacccctaacgggccccaaaccccgtacgtcgtaccaccgttccgtcgtttcccccg

SEQ ID NO: 403435 - DNA, 492 bp, Homo sapiens
  misc_feature: GZ8MTXP02FO5BG.13.11.A11.1.454.CMB.2.raw
  modified_base (315)..(315): a, c, t, g, unknown or other
tcagtcacgtactacacgaccggtgctcgatttagctacgactgcaggggagcttcagctgtggtagagaagacaggattcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaanaaatcggcccccgcaggggtccctgaccgattctctggctccagtctggcacctcagcctccctgtcatcactggctcagctgagatgaggctagattattctgcctagtcctatgacagcagcctgagtcgtcgttcggtattcgggcgggggaccaggctcggaccgtcgtacgg

SEQ ID NO: 403436 - DNA, 380 bp, Homo sapiens
  misc_feature: GZ8MTXP02HJ6OL.13.11.A11.1.454.CMB.2.raw
  modified_base (341)..(341): a, c, t, g, unknown or other
  modified_base (377)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcaagcgaactgtggctgcacatctgtctcatccttccgctatctgntagtacgtgactgagcgggctggcaaggcgcatagnnnn

SEQ ID NO: 403437 - DNA, 585 bp, Homo sapiens
  misc_feature: GZ8MTXP02G2EJV.13.11.A11.1.454.CMB.2.raw
  modified_base (302)..(302): a, c, t, g, unknown or other
  modified_base (377)..(377): a, c, t, g, unknown or other
  modified_base (461)..(461): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaggtgtccagtgtgaggtgcagctggtagagtcgtgggggaggtgtggtacggccgtgggggtccctcagactctcctgtgcaacctctggattcagatttgatgagtatggcatacacgtgggtcccnccaacctccgaggggaaggggctgcgaggtgggtctcgtaggtaataaacgtggaatggtgccagcaacaacttntgacagactcgtgtgaaacggggccctattacccgacctatcctacccgaagacgacaggtcgacccgaagaaacctccgtaanactctagactaaatcgaaactgtcgtacggagtcggaaggacctacgggtcctttaggtacttttcgaggttcgacgtagggttacgcgtaggttcggccgttaggtacctttacggactaagg

SEQ ID NO: 403438 - DNA, 532 bp, Homo sapiens
  misc_feature: GZ8MTXP02ILYK9.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccagggagtcctccccagtttctcctgaggttcaggtcaaactcagaataaacgacagggctctggacgtccccagcccgcttcctctggactcccaaggatgattccgcacgcagggatattactcatctctgggctccagtctgacgtagtgaggctagacttattacttgtttgactttggcaacacgaacgctggtactcgttacggaccgtgggaccacggtcaccgtctacggtcacgcccaaggcccaacccgactcgtacaccgtctacgtaccccc

SEQ ID NO: 403439 - DNA, 561 bp, Homo sapiens
  misc_feature: GZ8MTXP02HR9RR.13.11.A11.1.454.CMB.2.raw
  modified_base (190)..(190): a, c, t, g, unknown or other
  modified_base (233)..(233): a, c, t, g, unknown or other
  modified_base (370)..(370): a, c, t, g, unknown or other
  modified_base (386)..(386): a, c, t, g, unknown or other
  modified_base (444)..(444): a, c, t, g, unknown or other
  modified_base (470)..(470): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgngtatggttctggtatcagcagaaggcaggccagccccctgtccctactcattctttacaaaaactccgaggccggccccttcgtcggggtcccctggacgccgattccgtccccggctcccgctcgtgggaaccacngtcactctacgaccancacgccggacccagcctatgatgaggctgtctacttctgtcagggcgtgggacaacgngcgtgcgtggtcgggaggacggaccngtcgtacgtaccgttcgtacggacacgacccgaacggcctcccggtcccccgtcggtcctaccgttcccgttacccgtttacccccacccg

SEQ ID NO: 403440 - DNA, 557 bp, Homo sapiens
  misc_feature: GZ8MTXP02FVKGB.13.11.A11.1.454.CMB.2.raw
  modified_base (190)..(190): a, c, t, g, unknown or other
  modified_base (387)..(387): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtcctactcatctttacaaatccagcgcctctgggtccctgagcgattctccccgctccgctcgtggaacacagtccactctcgaccatcagccgggacccgacgtctagtagngaggcgtctcgtccttacttcgtcgtacggacgggtcgggtacggaacaacggcggtcggtcgtcggttcggtcggggacgggtaacgacgtacgtcgtacgtccgttacggtacgacgaccgaccgacgtccgcccgtcccgtcgtctccgtcgtcccggtccctcccg

SEQ ID NO: 403441 - DNA, 548 bp, Homo sapiens
  misc_feature: GZ8MTXP02FXP9R.13.11.A11.1.454.CMB.2.raw
  modified_base (283)..(283): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccgacaataggaactactagcttggaccaacagaaaccaggacagcctccgaagttactctttacnggctctacccggaatccgggtcctgaccgattcgagtggcaggcgggtctgggacagtactttcactctcaccatcagcagtccttcgaggctagaagtatgtggactaagttttatactgtcagtacaattattatatctctcctctcggtacgttcgaccgaagggaccagggtacgaaatacgaaaacgaactggtacggctaggccaactacttccgtcgttacttccgtacttcccttaccccgcctagtcctacgtaag

SEQ ID NO: 403442 - DNA, 505 bp, Homo sapiens
  misc_feature: GZ8MTXP02GA5VX.13.11.A11.1.454.CMB.2.raw
  modified_base (366)..(366): a, c, t, g, unknown or other
  modified_base (411)..(411): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttctctggactccaaggatgatccgcacgcagggatatacncatctctggctccagtctgacgatgaggctgactattactgtttnacttggcacaacacgctggatcttcggactgggaccaggtcaccgtcctaggtcacgcccaaggcccaacccactcgtccactctcgttccccg

SEQ ID NO: 403443 - DNA, 612 bp, Homo sapiens
  misc_feature: GZ8MTXP02HE3X5.13.11.A11.1.454.CMB.2.raw
  modified_base (200)..(200): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagagtgtcaccatctcttgttctggaggcagtgccaacagtcgggagtaattatgcattctggtatcaacactccaggacgccccagctcctcatctatagcaaataacccagccggccctacgacggggtcccctgacccccgtattccgtcgtcggcctaccgaagttccgtcgggacctacctccacgtcccctcccgtcggccactcgagtcgggctcccggtacgacgagtcgaggctagtattattactgtttcacgtcgttggatggacagtcctagtaagttacggttgggttttaccggcggggtaagggtaacccgtaaaggttccggacccggtacccgtaacggtaccgaacggtaccccgaacggtcccttaccggcccccgttacgggtccctacccg

SEQ ID NO: 403444 - DNA, 546 bp, Homo sapiens
  misc_feature: GZ8MTXP02J0P7L.13.11.A11.1.454.CMB.2.raw
  modified_base (393)..(393): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacaggctctggagtccccagccgcttctctggactccaaggatgatccgcacgcagggatattactcatctctgggctccagtctgacgagngagctagtactattattgttgtacgtagacacaacaacgacgtgtacgtcgttcgtacgtacggaccgaccggtaccgacccgtaccgtacgtaccgaccgacccgaaccgaacccgaaccccacctacgtacctaccgtccttccgtccccg

SEQ ID NO: 403445 - DNA, 527 bp, Homo sapiens
  misc_feature: GZ8MTXP02GSRD3.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctcccagttctcctgaggttcaggtacaaactcagataaacgacaggctctggagtccccacgccgcttctctggactaccagatgattccgccacgcagggatatactcatctcgtgggctccagtctgacgatggagctgaacttattacttggttgtactggacaacaacaaccgctggatcttcggacgtggaccacggtcaccgtccaggtaccacgaccccgaaggcccaaacccccgtatgtaccactccgttcgtccccc

SEQ ID NO: 403446 - DNA, 388 bp, Homo sapiens
  misc_feature: GZ8MTXP02JWAEV.13.11.A11.1.454.CMB.2.raw
  modified_base (345)..(345): a, c, t, g, unknown or other
  modified_base (382)..(388): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttccatcttcccgcatctgntagtacgtgactgagcgggctgggcaaggcgcatagnnnnnnn

SEQ ID NO: 403447 - DNA, 538 bp, Homo sapiens
  misc_feature: GZ8MTXP02JQ3TS.13.11.A11.1.454.CMB.2.raw
  modified_base (348)..(348): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccagggacgtcctccccagttctcctgaggttcaggtcaaactcagaataaacgacagggctcgtggacgtccccagccgcttctctggacctccgaaggntgacttccgacacgcagggatatactcatctcgtggctccagtctgacgatggagctgacttagttacttgtttcgacttggacctaacaacaacgtcctaggattccgttcggacctcgggaccacggtccaccgtcgtacggtccacgcccaacggcccaacccgactcgaccacctctcgtaccccc

SEQ ID NO: 403448 - DNA, 385 bp, Homo sapiens
  misc_feature: GZ8MTXP02FPEQE.13.11.A11.1.454.CMB.2.raw
  modified_base (342)..(342): a, c, t, g, unknown or other
  modified_base (379)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgcacttttattctgtcaccagtatggtaggtcaccgtacacttttggccaggggaccaagctggagatcaagcgaactgtggctgcacatctgtctccatccttcccgcatctgntagtacgtgacctgagcgggctggcaaggcgcatagnnnnnnn

SEQ ID NO: 403449 - DNA, 384 bp, Homo sapiens
  misc_feature: GZ8MTXP02I2FYO.13.11.A11.1.454.CMB.2.raw
  modified_base (240)..(240): a, c, t, g, unknown or other
  modified_base (342)..(342): a, c, t, g, unknown or other
  modified_base (377)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctactttattcngtcaccagtatggtaggtcaccgtacacttttggccaggggaccaagctggagatcaagcgaactgtggctgcaccatctgtcttcatccttccgcatctgntgtacgtgactgagcgggctggcaaggcgcatagnnnnnnnn

SEQ ID NO: 403450 - DNA, 386 bp, Homo sapiens
  misc_feature: GZ8MTXP02GQS9O.13.11.A11.1.454.CMB.2.raw
  modified_base (345)..(345): a, c, t, g, unknown or other
  modified_base (383)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacactttggccaggggaccaagctggagatcaagcgaactgtggctgcaccatctgtcttccatcttcccgccatcctgntagtacgtgactgagtcggggctggcaaggcgcatagnnnn

SEQ ID NO: 403451 - DNA, 543 bp, Homo sapiens
  misc_feature: GZ8MTXP02INGO5.13.11.A11.1.454.CMB.2.raw
  modified_base (271)..(271): a, c, t, g, unknown or other
  modified_base (393)..(393): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttcncctgaggttcaggtcaaactcagataaacgacagggctctggagtccccagccgcttctctggactccaaggatgacttccgccacgcagggatattactcatctctggctcagtctgacgntgaggctagacttattactgtttgacttggcaacaacaacgcctggactcttacggaccgttcgggaaccacgggtccaccggttcctagggtccaacggcccaaacgggcccaaaccccgcttacgtacacctttccttacgtaccccc

SEQ ID NO: 403452 - DNA, 506 bp, Homo sapiens
  misc_feature: GZ8MTXP02JPW7S.13.11.A11.1.454.CMB.2.raw
  modified_base (328)..(328): a, c, t, g, unknown or other
  modified_base (341)..(341): a, c, t, g, unknown or other
  modified_base (449)..(449): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgtgcagtggcaccaatgttggtccctatgacatatattggtaccgacagaagccagggagtcctccccagttctcctgaggttcaggtcaaactcagataaacgacaggctctggagtccccagccgcttcnctggatccaaggntgattccgcacgcagggatatactcatctctggctccagtctgacatgaggctgactattactgttgacttggcacaacaacgcctggactcttcggacctgggaccncggtcaccggtctacggcacgcccaaggcccaacccactcgtacactctcgtccccc

SEQ ID NO: 403453 - DNA, 487 bp, Homo sapiens
  misc_feature: GZ8MTXP02GII28.13.11.A11.1.454.CMB.2.raw
  modified_base (415)..(415): a, c, t, g, unknown or other
  modified_base (469)..(469): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacaggctctggagtccccagccgcttctctggactccaaggatgattccgcacgcagggatatactcatctctggctcagtctgacatgagctgactattactgttgacttggcanaacagctgatctcgactggacacggtcacgtcaggtcacgccaagccaaacccnctcgcactctcgtccccg

SEQ ID NO: 403454 - DNA, 336 bp, Homo sapiens
  misc_feature: GZ8MTXP02I56FD.13.11.A11.1.454.CMB.2.raw
  modified_base (332)..(336): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagactttgctacttttatttctgtcgaccagtatggaactgtgctgcaccatctgtcttcatccttcccgcatctgatagtcgtgactgagcggctggcaggcgcatagnnnnn

SEQ ID NO: 403455 - DNA, 716 bp, Homo sapiens
  misc_feature: GZ8MTXP02IJXV8.13.11.A11.1.454.CMB.2.raw
  modified_base (172)..(172): a, c, t, g, unknown or other
  modified_base (213)..(213): a, c, t, g, unknown or other
  modified_base (233)..(233): a, c, t, g, unknown or other
  modified_base (243)..(243): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtcgtcccaggacagacagccagcatcactgctnagaaataatgacagataatntactctgtancagacagagtcagccagtcccctgtcgctggtcatactatacaagactacgaccgtaacggcccgtaccccgtacggaacggggtacctcccccgtaggacgtaccgttacgtttcctccggttacgggtacccttacccgtaaaaccgtttccgggtaaccgggtaaacccttcgaaaccgtacccctaaacttccgtaacccggtaaccctaacgtacccggaaacccggggacccggggaacccccgtaagggtaccgttaacggtagggacgttaacggggaccggttcgtaacggtttaacctttaacgtttacgtacggttacccggaggggtaccggttacggggaacaggaccgtaacggcctaaccggtccgaacccgtgtttaacggtccgttaccggtaacggtacgtacggggtaaaccgtacggtaccctaccgtaacgtacgtaccgaacggaaccccg

SEQ ID NO: 403456 - DNA, 385 bp, Homo sapiens
  misc_feature: GZ8MTXP02F5FB1.13.11.A11.1.454.CMB.2.raw
  modified_base (381)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagactttgctacttttatttctgtcaccagtatggtaggtcaccgtacactttggccaggggaccaagctggagatcaagcgaactgtggctgcaccatctgtctcatccttccgccatctgatagtacgtgactgagcgggctggcaaggcgcatagnnnnn

SEQ ID NO: 403457 - DNA, 512 bp, Homo sapiens
  misc_feature: GZ8MTXP02GGJRT.13.11.A11.1.454.CMB.2.raw
  modified_base (346)..(346): a, c, t, g, unknown or other
  modified_base (489)..(489): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctcgtggactccaaggntgacttccgcacgcagggatatactcatctctgggctccagtctgacgatgaggctgacttattactgtttgacttggcacaacacgctggatctcggactggaccaggtcaccgtctaggtcacgcccgaggcccaaccccnctacgtcactcgtcgttcccccg

SEQ ID NO: 403458 - DNA, 546 bp, Homo sapiens
  misc_feature: GZ8MTXP02GIV98.13.11.A11.1.454.CMB.2.raw
  modified_base (365)..(365): a, c, t, g, unknown or other
  modified_base (367)..(367): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcattctttacaaaatccaggccgccctcgtcggggtcccctggacgcgtacttcctccccgggctcccgcctcgtgggaaaccncngtccactctgaccatcacgccgggacccagcctatgatgagctgtctacttctgtcaggcgtgggacaacgagcgtgcgtggttcggcggtacgggacgagtcgtcgaccgttcgtacggtcgacgacccgaaggccgtccgcccccgtcggtccaccgtcctccgttcccctaccccg

SEQ ID NO: 403459 - DNA, 386 bp, Homo sapiens
  misc_feature: GZ8MTXP02JVU0N.13.11.A11.1.454.CMB.2.raw
  modified_base (344)..(344): a, c, t, g, unknown or other
  modified_base (380)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacactttggccaggggaccaagctggagatcaagcgaactgtggctgcaccatctgtcttccatcttcccgcatctgntagtacgtgactgagcgggctggcaaggcgcatagnnnnnnn

SEQ ID NO: 403460 - DNA, 495 bp, Homo sapiens
  misc_feature: GZ8MTXP02JV04K.13.11.A11.1.454.CMB.2.raw
  modified_base (407)..(407): a, c, t, g, unknown or other
tcagtcacgtactacacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtgttatactatgtctcctggtatcaacaacacccaggcaaacgcccccaaactcatcatttatgaagtcatttatcggccctcagggtatttctaactcgcttctctggctcagtctggcacacgcctccctgaccatctctgggctcgagctgaagcgagctgattatactgnagctacatatacacatacaaacacacagtcttacggaagtacgggaccaaagtccaccgtctaggcacgacccacggcccaacctacg

SEQ ID NO: 403461 - DNA, 515 bp, Homo sapiens
  misc_feature: GZ8MTXP02H592X.13.11.A11.1.454.CMB.2.raw
  modified_base (355)..(355): a, c, t, g, unknown or other
  modified_base (357)..(357): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccggacagacagcctacatcacctgctctggagatgtattgactaacgagtatggttcctggtatcagcagaaggcaggccagccccctgtccctatcatctttacaaaatccaggccggccctcgtcggggtccctggacgcgattctccccggctcccgctctgggaacncngtcactctgaccatcagcgggacccagcctatggatgaggctgactatactgtcatacagtgggacaacgatagttggatggctggttcggacggagggaccaaagcgaaccgtctacggtcacgcccaaaggcctacgccccctggcctactctccg

SEQ ID NO: 403462 - DNA, 566 bp, Homo sapiens
  misc_feature: GZ8MTXP02H99VB.13.11.A11.1.454.CMB.2.raw
  modified_base (243)..(243): a, c, t, g, unknown or other
  modified_base (261)..(261): a, c, t, g, unknown or other
  modified_base (272)..(272): a, c, t, g, unknown or other
  modified_base (304)..(304): a, c, t, g, unknown or other
  modified_base (333)..(333): a, c, t, g, unknown or other
  modified_base (375)..(375): a, c, t, g, unknown or other
  modified_base (381)..(381): a, c, t, g, unknown or other
  modified_base (423)..(423): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggaccganagaagccagggagtcccnccccagtttcncctgaggttcaggtcaaactcagataaacganagggctctgggacgtccccagccgcttcnctcggatccgaagatgacttcccgcaaacgcagggatatacnatcctnggctccagtctgacgatgaggctagaacttattactggtttnacttggacaacaaactacgcctggtactcgttacgggaccttcggggaacctcgggtacctacccggtacgttaacgggtcaccgacccccgaaacgggaccccctaaacccccgatccggtaccaacctttccggtaccccg

SEQ ID NO: 403463 - DNA, 505 bp, Homo sapiens
  misc_feature: GZ8MTXP02JQGLH.13.11.A11.1.454.CMB.2.raw
  modified_base (343)..(343): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgagttcaggtcaaactcagataaacgacagggctctggacgtccccagccgcttctctggactccaaggntgatccgcacgcagggatattactcatctctgggctcagtctgacatgaggctgactattactgtttgattggcacaacacgctggatcgtgacctgggaccacggtcaccgtctaggtcacggcccaaggcccaacccacgtcgcactcgtcgttcccccg

SEQ ID NO: 403464 - DNA, 539 bp, Homo sapiens
  misc_feature: GZ8MTXP02HQ63J.13.11.A11.1.454.CMB.2.raw
  modified_base (369)..(369): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccaggagtcctccccagtttctcctgagttcaggtcaaactcagataaacgacaggctctggacgtcccagccgcttctctggactccgaaggatgacttccgccaacgcaggatattacncatctctggctccgagtctagacgatgagctgactattactgtttagacttggcaacaacaacgcctaggatcgttacggaccgttcgggaccacgggtccaccggtacctacggtcaacggacccccaaaggccccaaaccccgtacgtacgtcctaacctcgttcccg

SEQ ID NO: 403465 - DNA, 471 bp, Homo sapiens
  misc_feature: GZ8MTXP02HVBVP.13.11.A11.1.454.CMB.2.raw
  modified_base (364)..(364): a, c, t, g, unknown or other
  modified_base (380)..(380): a, c, t, g, unknown or other
  modified_base (399)..(399): a, c, t, g, unknown or other
  modified_base (460)..(460): a, c, t, g, unknown or other
  modified_base (463)..(463): a, c, t, g, unknown or other
  modified_base (465)..(471): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatttatcaggagaccactgacatcccagacaggttcagtggcagtgggtctgggacagacttcactctcaccatcagcaagacgtacgaacctagaacttcttgaccttactttttattctcgtccaacgtagtagtggtacgtacctaacgtacttacggtttcggaccggtaacgggaaccaagtcgtaggaactactacgaaacggacgtaacgtggtcggctcgacctaactntccgttctcctttacnccccgtttcccttaccccncttatcgtagtaagttcgtacgtagtaccgtgggacgggtcgggcagggaaccgaggccanagngnnnnnnn

SEQ ID NO: 403466 - DNA, 334 bp, Homo sapiens
  misc_feature: GZ8MTXP02FVJ8G.13.11.A11.1.454.CMB.2.raw
  modified_base (241)..(241): a, c, t, g, unknown or other
  modified_base (323)..(323): a, c, t, g, unknown or other
  modified_base (329)..(334): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcagaaggaccactgacatcccagacaggttcagtggcagtgggtctgggacagacttcactctcaccatcagcagactggaacctgaagactttgctactttattcngtcacagtatggaactgtggctgcaccatctgtcttcatcttcccgcatctgatagtacgtgactgagcggctggcaaggcncatagnnnnnn

SEQ ID NO: 403467 - DNA, 524 bp, Homo sapiens
  misc_feature: GZ8MTXP02F1837.13.11.A11.1.454.CMB.2.raw
  modified_base (190)..(190): a, c, t, g, unknown or other
  modified_base (326)..(326): a, c, t, g, unknown or other
  modified_base (347)..(347): a, c, t, g, unknown or other
  modified_base (349)..(349): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtcctactcatctttacaaatccaggcgccctcgtgggtccctgagcgattcncccggctccgctcgtggaacncngtcactctcgaccatcacgccggacccagcctatgatgagctgtctacttcgtagtcgaggtcgtagggacaacgagcgtgcgtggttcggcggacggaccgagtctggaccgtcgttaggcgacgacccgaaggcctccggccccctcggtcctacgtctcgtcccccgtcccg

SEQ ID NO: 403468 - DNA, 540 bp, Homo sapiens
  misc_feature: GZ8MTXP02IZX3N.13.11.A11.1.454.CMB.2.raw
  modified_base (523)..(523): a, c, t, g, unknown or other
tcagtcacgtactacacgaccggtgctcgatttagctacgactgcgggggtaagaggttgtgtccgaccatggcctggactcctctcctcctcctgctcctctctcactgcacaggttccctctcgcaggctgtgctgactcagccgtcttccctctctgcttctcctggtagcgtcagccagtctcacctgcaccttgcgcaggtggcaccaatgttggtccctatgacatatattggtaccgacagaagccagggagtcctccccagttctcctgagttcaggtcaaactcagataaacgacagggctcgtggacgtccccagcccgcttctctggactcccgaagggtatcggatttcccgccacggccaggggtatacttactcgacttctcgtgggccttccagtctgacgatgaggctgacttattactgtttgacttggcaacaacacgcctggactcgttacgaccgttgggacctacgggtcaaccgtctacggtcacgcccaaggccaacccntacgcactctcttcccc

SEQ ID NO: 403469 - DNA, 385 bp, Homo sapiens
  misc_feature: GZ8MTXP02IS9KN.13.11.A11.1.454.CMB.2.raw
  modified_base (344)..(344): a, c, t, g, unknown or other
  modified_base (383)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaacctgaagtactttgctactttattctgtcaccagtatggtaggtcaccgtacacttttggccaggggaccaagctggagatcaagcgaactgtgctgcaccatctgtcttcatcttcccgcatctgntagtacgtgactgagcggggctgggcaaggcgacatagnnn

SEQ ID NO: 403470 - DNA, 333 bp, Homo sapiens
  misc_feature: GZ8MTXP02HM6NS.13.11.A11.1.454.CMB.2.raw
  modified_base (331)..(333): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcagaaggaccactgacatcccagacaggttcagtggcagtgggtctgggacagacttcactctcaccatcagcagactggaacctgaagactttgctatttattctgtcaccagtatggaactgtggctgcaccatctgtcttcatcttcccgccatctgatagtacgtgactgagcggctggcaaggcgcatagnnn

SEQ ID NO: 403471 - DNA, 381 bp, Homo sapiens
  misc_feature: GZ8MTXP02F3YIV.13.11.A11.1.454.CMB.2.raw
  modified_base (379)..(381): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgttcggccatgggaccaaggtggaaatgaaacgaactgtggctgcatcatctgtcttcatcttcccgcatctgatagtacgtgactgagcgggctggcaaggcgcatagnnn

SEQ ID NO: 403472 - DNA, 523 bp, Homo sapiens
  misc_feature: GZ8MTXP02JIB1T.13.11.A11.1.454.CMB.2.raw
  modified_base (372)..(372): a, c, t, g, unknown or other
  modified_base (398)..(398): a, c, t, g, unknown or other
  modified_base (466)..(466): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagaataaacgacaggctcgtggacgtccccagccgcttctcgtggactccgaaggatgacttccgcacgcagggatatacncatctcgtggctcagtctagactagngaggctagacttaattcttgtttgacttggactaacaacgaacgctggatccgttcggactcggaccncggtcaccgtctacggtcacgccaacggcccaacccgatcgtcacctctcgtccccg

SEQ ID NO: 403473 - DNA, 520 bp, Homo sapiens
  misc_feature: GZ8MTXP02HTAAZ.13.11.A11.1.454.CMB.2.raw
  modified_base (190)..(190): a, c, t, g, unknown or other
  modified_base (383)..(383): a, c, t, g, unknown or other
  modified_base (435)..(435): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtcctactcatctttacaaaataccaggcgccctcgtggggtccctgagcgattctcctgcctcaactctgggaactcagccactctgaccatcagcggacccaggctanggatgaggctgactattactgtcaggcgtgggacagcagcactcgccccgtntagtcgtcgtacggacgtacgggacctacggtccgtaccgtacctaacgtccgaacgacccgaacgacccaaccctacgtcgtcc

SEQ ID NO: 403474 - DNA, 521 bp, Homo sapiens
  misc_feature: GZ8MTXP02FV8AV.13.11.A11.1.454.CMB.2.raw
  modified_base (381)..(381): a, c, t, g, unknown or other
tcagtcacgtactacacgaccggtgctcgatttagctacgactgcgggggtaagaggttgtgtccaccatggcctggactcccctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggatccctccccagtttctcctgaggttcaggtacaaactcaagataaacgacagggctcgtggacgtccccagccgtcttctctggactcccaaggatgacttccgaccaacgcgagggatattacncatctcgtggctccgagtctgacgatgagctgactattactgttgacttgactacaacacgctagatcgtcgacgtggaccacggtcaccgtcgtaggtcacgacccacgcccaacccgctacgcactctcgtccctccc

SEQ ID NO: 403475 - DNA, 529 bp, Homo sapiens
  misc_feature: GZ8MTXP02I8LNR.13.11.A11.1.454.CMB.2.raw
  modified_base (380)..(380): a, c, t, g, unknown or other
  modified_base (508)..(508): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagaataaacgacagggctcgtggacgtccccagcccgcttctctggactccaaggatgacttccgacacgcagggatattactcatctntggctcagtctgacgatgagctgacttattacgttgtttgactttggacaacgaacaacgccttaggacttccgttcggacctgggaccacggtccaccgtcgtacgtcacgcccaaggcccaacccnctcgccacgtctcgtaccccc

SEQ ID NO: 403476 - DNA, 506 bp, Homo sapiens
  misc_feature: GZ8MTXP02GZRJZ.13.11.A11.1.454.CMB.2.raw
  modified_base (190)..(190): a, c, t, g, unknown or other
  modified_base (325)..(325): a, c, t, g, unknown or other
  modified_base (348)..(348): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtccctactcatctttcaaataccaggcgcctctggggtcctgagcgattcnccccggctccgctctgggacacngtcactctgaccatcagcggaccagcctatgatgaggctgtctacttctgtcaggcgtgggacacgagcgtgctgtcggcggtaggccagtcgtgaccgtcgtaggtcacgcccgaaggcctcgccccctcggtccacgtccgtcgttccccgtcccc

SEQ ID NO: 403477 - DNA, 385 bp, Homo sapiens
  misc_feature: GZ8MTXP02I3VDO.13.11.A11.1.454.CMB.2.raw
  modified_base (241)..(241): a, c, t, g, unknown or other
  modified_base (341)..(342): a, c, t, g, unknown or other
  modified_base (378)..(385): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagctttgctactttattcngtcaccagtatggtaggtcaccgtacacttttgcctaggggaccaagctggagatcaagcgaactgtggctgcacatctgtcttcatcttcccgcatctnntagtacgtgactgagcgggctggcaaggcgcatagnnnnnnnn

SEQ ID NO: 403478 - DNA, 543 bp, Homo sapiens
  misc_feature: GZ8MTXP02JIL78.13.11.A11.1.454.CMB.2.raw
  modified_base (236)..(236): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctggtatcagcagaagtcaggccagtcccctgtgctggtcatctatcaagatgccaagcggccctgagggactcccccgtgagcgattctctggcctccaactcgtagggaactcagcccactctgaccatcacgcggaccccaggcctagtcggatggaggctaggactattacgtgtccgagggcgtggggacaggccagccacgtcggcccgtctacgtcgttccgttacgggaaaccgttggggaacccgtaagggtacccacccggttacctaacggttaccgacggaacccccgg

SEQ ID NO: 403479 - DNA, 507 bp, Homo sapiens
  misc_feature: GZ8MTXP02FVCJ2.13.11.A11.1.454.CMB.2.raw
  modified_base (498)..(498): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgctctctggactccaaggatgattccgcacgcagggatatactcatctctggctccagtctgacgatgaggctgactattactgtttgacttggacacaaacaacgcctggatcgttcgacctggaccacggtcaccgtctaggtccacgcccaaggcccaacccactcgcactcncgttccccg

SEQ ID NO: 403480 - DNA, 389 bp, Homo sapiens
  misc_feature: GZ8MTXP02GAPD9.13.11.A11.1.454.CMB.2.raw
  modified_base (380)..(380): a, c, t, g, unknown or other
  modified_base (386)..(389): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagtattttgcagtatattcctgtcacctagtttggtgactcaacgtggacgttcggccagtgggaccaaggtggaaatgaaacgaactgtggctgcaccatctgtcttcatcttcccgcatcctgatagtacgtgactgaggcgggctgggcaagggcncatagnnnn

SEQ ID NO: 403481 - DNA, 334 bp, Homo sapiens
  misc_feature: GZ8MTXP02I73H7.13.11.A11.1.454.CMB.2.raw
  modified_base (326)..(326): a, c, t, g, unknown or other
  modified_base (332)..(334): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtggctgcaccatctgtcttcatcctcccgcatctgatagtacgtgactgagcgggctggcaaggcncatagnnn

SEQ ID NO: 403482 - DNA, 619 bp, Homo sapiens
  misc_feature: GZ8MTXP02GZG6L.13.11.A11.1.454.CMB.2.raw
  modified_base (578)..(578): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccgacagaagccagggacgtccctcccctagttctcctgtaggttcaggtaccaaactcaagaactaaacgacgaggctcgtggacgtccccagccgcttctctggactaccgaaggatgacttccgacacgcaagggtatacttactcatcctcgtggctccagtctagacgatggacggtctagtacttaattcgttaggtttcgtacgttcggacaaccaaacgaaccgccgttagggtaacttccgttaccgggaccgtcggggtaacccacggggttcccaacccggttccgtaacgggtcccaacggaccccaaacgggcccccgtaaaaccccncgttaccggtaccctaccgttcccttacggtttaccccccg

SEQ ID NO: 403483 - DNA, 388 bp, Homo sapiens
  misc_feature: GZ8MTXP02HBVA8.13.11.A11.1.454.CMB.2.raw
  modified_base (360)..(360): a, c, t, g, unknown or other
  modified_base (383)..(388): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagtttggtgactcaacgtggacgttcggccatgggaccaaggtggaaatgaaacgaactgtggctgcaccatctgtcttcatcttcccgctatccctgatagtacgtgactgngcgggctgggcaaggcgcatagnnnnnn

SEQ ID NO: 403484 - DNA, 574 bp, Homo sapiens
  misc_feature: GZ8MTXP02G4HIN.13.11.A11.1.454.CMB.2.raw
  modified_base (343)..(343): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttctctggactccaaggntgattccgcacgcagggatatactcatctctgggctccagtctgacgatgaggctagacttattacgtgtttcgacttggacaacaaacgaacgtcccgtaggaacttcgttaccggaccgttcgggaacccacgggttccacccggttacccgtaacggggtaccacggaccccaaacgggcccctaaaacccccacgttcgtaccaaccttccgttacgtttacccccc

SEQ ID NO: 403485 - DNA, 563 bp, Homo sapiens
  misc_feature: GZ8MTXP02INRXX.13.11.A11.1.454.CMB.2.raw
  modified_base (376)..(376): a, c, t, g, unknown or other
  modified_base (413)..(413): a, c, t, g, unknown or other
  modified_base (514)..(514): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtgtggtacggccgtgggggtccctcagactctcctgtgcaacctctggattcagattgatgagtatggcatacacgtgggtcccgccaacctccgaggggaaggggctgcgagtgggtctcgtaggtataaacgtggaatggtcgccagcaacaacttntgacagactctgtagaaacgggccctaattccaaccntcctacccaagagaccaggtcgacccgaagaaacctccgtaacattcagacaaatgaaacagtctcgggagtccgagacctacggtcctttgtactttcgngtcgacgtaaggttacgcgtaggtcggtctaggtacttacggctaaagg

SEQ ID NO: 403486 - DNA, 525 bp, Homo sapiens
  misc_feature: GZ8MTXP02FP72D.13.11.A11.1.454.CMB.2.raw
  modified_base (331)..(331): a, c, t, g, unknown or other
  modified_base (374)..(374): a, c, t, g, unknown or other
  modified_base (499)..(499): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgtaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttcnctggatccccgaggatgacttccgccaacgcagggatattacncatctctggctccagtctgacgatgagctgactattactgttgacttgcacaacaccgctggatcgttcggacctgggaccacggtccaccggtcctagggtcacgcccaacggacccaaccccnctacgtccactctcggtcccctcccc

SEQ ID NO: 403487 - DNA, 388 bp, Homo sapiens
  misc_feature: GZ8MTXP02IS7N3.13.11.A11.1.454.CMB.2.raw
  modified_base (347)..(347): a, c, t, g, unknown or other
  modified_base (384)..(388): a, c, t, g, unknown or other
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcagtgggtctgggacagacttcactctcaccatcagcagactggaacctgaagtactttgctactttattctgtcaccagtatggtaggtcaccgtacacttttggccaggggaccaagctggagatcaagcgaactggtggctgcaccatctgtctcatcctcccgccatctgntagtacgtgactgagcgggctggcaaggcgacatagnnnnn

SEQ ID NO: 403488 - DNA, 383 bp, Homo sapiens
  misc_feature: GZ8MTXP02H5OA9.13.11.A11.1.454.CMB.2.raw
  modified_base (344)..(344): a, c, t, g, unknown or other
  modified_base (381)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacactttggtcaggggaccaagctggagatcaagcgaactgtggctgcaccatctgtcttcatcttcccgcatcctgntagtacgtactgagcggggctgggcaaggcgcatagnnn

SEQ ID NO: 403489 - DNA, 382 bp, Homo sapiens
  misc_feature: GZ8MTXP02GR9LI.13.11.A11.1.454.CMB.2.raw
  modified_base (339)..(339): a, c, t, g, unknown or other
  modified_base (375)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcacagtatggtagtcaccgtacactttggccaggggaccaagctggagatcaagcgaactgtgctgcacatctgtctcatctcccgctatctgntagtacgtgactgagcgggctggcaaggcgcatagnnnnnnnn

SEQ ID NO: 403490 - DNA, 632 bp, Homo sapiens
  misc_feature: GZ8MTXP02GTMM5.13.11.A11.1.454.CMB.2.raw
  modified_base (236)..(236): a, c, t, g, unknown or other
  modified_base (249)..(249): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctagtancagcaagagtcgacgccacgtccctgtcgcgtggtcatctatacgaagtctcgaccgaaggcccgacctacggacgggtactcccccgtagacgtacgtacttccgtcgtcggtcctacctaacgtcggtacggaacctcgacgccctacgtctacgaaccagtcgacgggacccggacccgaggtaccttaagggaggacgtaggacgtacgtacgttaacttacgttacggtcggtacggagggtcggtacggaacacgacgacgaccgtacggtccggtaccgttacgttacgtaccggttaccggtaaccggtaacggtaccgggtaaccgtaccggtacccgtaccggtaccgtaacggtacccgaaccggtaacccg

SEQ ID NO: 403491 - DNA, 404 bp, Homo sapiens
  misc_feature: GZ8MTXP02HX79U.13.11.A11.1.454.CMB.2.raw
  modified_base (395)..(404): a, c, t, g, unknown or other
tcagtcacgtactacacgaccggtgctcgatttagctacgactgcagggccaatcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactactttggccaggggaccaagcgtggagatcgaagcgaactgtggctgcacatctgtctcatcctcccgctatctgattagtacgtgtacgtgacggcgggctacggcaaaggcgtacgagtagnnnnnnnnnn

SEQ ID NO: 403492 - DNA, 563 bp, Homo sapiens
  misc_feature: GZ8MTXP02I2S1B.13.11.A11.1.454.CMB.2.raw
  modified_base (365)..(365): a, c, t, g, unknown or other
  modified_base (414)..(414): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagcctacatcacctgctctggagatgtattgactaacgagtatggttcctggtatcagcagaaggcaggccacgccccctgtccctactcattctttacaaaatccaggcgccctcgtcggggtccctgacgcgtattccgccccggctcccgcctcgtagggaaccacngtcactctgaccatcgagccgggacccagcctatgatgagctgctactntgtcaggcgtggacacagcgtgctgggtcggcggagggacctaggtccgtggaccgttcgttaagggccaacggcccccgaaaggtccccgtccgtcccccccgttacgggtccctacccgttccgtttccgtttacccccctaccccg

SEQ ID NO: 403493 - DNA, 520 bp, Homo sapiens
  misc_feature: GZ8MTXP02JVPKG.13.11.A11.1.454.CMB.2.raw
  modified_base (191)..(191): a, c, t, g, unknown or other
  modified_base (234)..(234): a, c, t, g, unknown or other
  modified_base (360)..(360): a, c, t, g, unknown or other
  modified_base (455)..(455): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgngtatggttcctggtatcagcagaaggcaggccagccccctgtcctactcatctttacaaaataccaggcgccctcgtcggggtccctgagcgacttctccccggctccgcctcgtacgggaacacngtcactctgaccatcagcgacccagcctatcgagtgagtctgtctacttctgtcaggcgtgggacacgagcgtgcgtggtcggcggacggaccgngtcgtcgtcgtcgtacgcacgaccgacgccgtccgccccgtcgtcctcgtccgtccgtcccgtcc

SEQ ID NO: 403494 - DNA, 490 bp, Homo sapiens
  misc_feature: GZ8MTXP02J2HGS.13.11.A11.1.454.CMB.2.raw
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcaggggactcccccctgagcgattctctggcctccaactctgggaactcagccactctgaccatcagcggaccaggctatgatgagctgactatactgtcaggcgtgggacaggcagcacgtcgcccgctatcgtctcggaactgggaaccaacggtcaccggtacctacgtcacgacccg

SEQ ID NO: 403495 - DNA, 379 bp, Homo sapiens
  misc_feature: GZ8MTXP02H7C7T.13.11.A11.1.454.CMB.2.raw
  modified_base (370)..(370): a, c, t, g, unknown or other
  modified_base (373)..(373): a, c, t, g, unknown or other
  modified_base (375)..(379): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacactttggccaggggaccaagctggagatcaagcgaactgtgctgcacatctgtcttccatcttcccgctatctgatagtactgactgagcgctggcaaggcncangnnnnn

SEQ ID NO: 403496 - DNA, 547 bp, Homo sapiens
  misc_feature: GZ8MTXP02HJVI8.13.11.A11.1.454.CMB.2.raw
  modified_base (270)..(270): a, c, t, g, unknown or other
  modified_base (347)..(347): a, c, t, g, unknown or other
  modified_base (373)..(373): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtcctccccagtttcncctgaggttcaggtcaaactcagataaacgcagggctcgtggacgtccccagcccgtcttctctggactccgaaggntgacttccgcacgcagggatattacncatctctggctccagtctgacgatggagtctagacttattactgtttcgacgttggacacaaacgacgcctaggattccgtcgggacctggggacccacggtccaccggttccgtacgggtccacggacccgacggaacccctaaccccactcgtacaccttctcgttaccccc

SEQ ID NO: 403497 - DNA, 509 bp, Homo sapiens
  misc_feature: GZ8MTXP02GG5A7.13.11.A11.1.454.CMB.2.raw
  modified_base (286)..(286): a, c, t, g, unknown or other
  modified_base (362)..(362): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactctttacnggcgtctacccgggatcccggggtcctgaccgattcagtggcagcgggtctgggacagactttcactctcacatcngcagccttcaggctgaagatgtggcagtttatactgtcagcaatattatatctctcctcctcgacgttcgaccgtaaggaccagggtagaaatcgaaaacgaactgtaggctcggacaccatctgtctcatccttccgccatctgta

SEQ ID NO: 403498 - DNA, 530 bp, Homo sapiens
  misc_feature: GZ8MTXP02G91N0.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctcccagtttctcctgaggttcaggtcaaactcagataaacgacagggctctggacgtccccagccgcttctctcggatccaaggatgacttcccgcctaacgcgaaggggattacgttactcaatctcgtcgggctcagtctagacgatgagctgactattactgtttgacttggacactaacgaacgcctggacttctcggacctcgggacctacggtccacgtctacggtcacggaccaaggcccaacccactcgtccactctacccg

SEQ ID NO: 403499 - DNA, 743 bp, Homo sapiens
  misc_feature: GZ8MTXP02J2WS5.13.11.A11.1.454.CMB.2.raw
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacctgcgcagtgcacaatgtgtcctatgacatatattggtaccacagaagccgagggacgtccctcccctagttctcctgtaggttcaggtacaaactcaagaactaaacgacgaggctcgtggacgtcccagcccgcttctcgtggacctaccgaaggtactagtacttcccgaccgaccggacgaaggggtaactaatttacctactaacttccttcgttcgggttcccttacccgtaacggttccttacggaaccgtagttacgggaacggtccgttacggtaactttaacgttttaaaccgtttgggttttacggtacgtttcgggacctaaaccgtaaaaccaaacccggtccctaggggttaaccttccggtttacccggaacccggttaccggggtaaccccgtaaccggggttaccccgaaccccgggtttacccgttaacgggtacccgaaccggtacccccgaaaaccggggtaacccccaaaaccccccggtacctccggttaccccgtaacccttacccggtttcccgtttaacccccccg

SEQ ID NO: 403500 - DNA, 498 bp, Homo sapiens
  misc_feature: GZ8MTXP02JRIAC.13.11.A11.1.454.CMB.2.raw
  modified_base (328)..(328): a, c, t, g, unknown or other
  modified_base (418)..(418): a, c, t, g, unknown or other
  modified_base (483)..(483): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttcnctggatccaggatgattcgcacgcagggatatactcatctctgggctccagtctgacgatgaggctgactattactgttgacttggctanaacacgcctggatctcgactgggtaccacgtcaccgtctacggtcagcccaaggcccaaaccccnctcgcactctctccc

SEQ ID NO: 403501 - DNA, 675 bp, Homo sapiens
  misc_feature: GZ8MTXP02IVBJ6.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtcttctcgtgtacgtcgacgtacaactcgaagaaacgtaaacgaacggacggtcctcggtacgggtacccgtacccgaccggccgtccttccgtcggtacggtactaccgaagtacgtacgtaccgttcccgaccgaacgacggaacgggtattaacttactactacttctcggtcggtccctacgtacgttcgtacggaaccgtaggtcggaacggtcgtaacgttaactttaacgtttacgtttggtttacgtacgttcggaacctaaaaccgaaccgaaccgtccgtaagtaccgtttaccgtaccggaccggttacggacccgtaccggtaccgtacccgtacgtacgtaccacccgaccgaacccgaccccaaacctcgtacgtaccctacgtccgtttccccg

SEQ ID NO: 403502 - DNA, 516 bp, Homo sapiens
  misc_feature: GZ8MTXP02I4LH8.13.11.A11.1.454.CMB.2.raw
  modified_base (286)..(286): a, c, t, g, unknown or other
  modified_base (319)..(319): a, c, t, g, unknown or other
  modified_base (488)..(488): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactactagcttggtacccaacagaaaccaggacagcctccgaagttactctttacngggctctacccgggatccggggtccctgaccgnttcagtggcaggcgggtctggggacagtactttccactctcaccatcagcagccttcaggctagaagatgtggctagtttattactgtcagcaatattatagtactcctcgagctcacgttcggcggaggaccaaggtggagatacgaaacgactgcggactcgcaccntctgtcttcactccttacccgctacttc

SEQ ID NO: 403503 - DNA, 387 bp, Homo sapiens
  misc_feature: GZ8MTXP02IM9SR.13.11.A11.1.454.CMB.2.raw
  modified_base (345)..(345): a, c, t, g, unknown or other
  modified_base (382)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggacaactgacatcccagacaggttcagtggcagtgggtctgggacagacttcactctcaccatcagcagactggaacctgaagtactttgctactttattctgtcaccagtatggtaggtcaccgtacactttggcctaggggaccaagctggagatacaagcgaactgtgctgcaccatctgtcttcactcttcccgcatctgntacgtacgtgactgagcgggctggcaaggcgcatagnnnnnn

SEQ ID NO: 403504 - DNA, 503 bp, Homo sapiens
  misc_feature: GZ8MTXP02ID5XX.13.11.A11.1.454.CMB.2.raw
  modified_base (367)..(367): a, c, t, g, unknown or other
  modified_base (393)..(393): a, c, t, g, unknown or other
tcagtcacgtactacacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtgttatactatgtctcctggtatcaacaacacccaggcaaacgcccccaaactcatcatttatgaagtcatttatcggccctcagggtatttctaatcgcttctctgctcagtctgctaacacgctcctgaccanctctgggctccaggctgagacgagcngtattattactgacagtctcatatacaaccatcaaacacacagtcttacggaagttcgggacaaacgttcaccgtaacgtacggtacacggaccaacggccaacccaccg

SEQ ID NO: 403505 - DNA, 383 bp, Homo sapiens
  misc_feature: GZ8MTXP02FL0VW.13.11.A11.1.454.CMB.2.raw
  modified_base (342)..(342): a, c, t, g, unknown or other
  modified_base (378)..(383): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacactttggccaggggaccaagctggagatcaagcgaactgtggctgcaccatctgtcttccatctcccgccatctgntgtacgtgactgagcgggctggcaaaggcgcatagnnnnnn

SEQ ID NO: 403506 - DNA, 587 bp, Homo sapiens
  misc_feature: GZ8MTXP02IJOD2.13.11.A11.1.454.CMB.2.raw
  modified_base (348)..(348): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagaataaacgacaggctcgtggacgtccccagcccgcttctcgtggactccgaagntgattccgcacgcagggatattactcatctctggctcagtctgacgatgaggctagacttattacttgtttcgtactttgggactaaccaacgacgtactggaacttcgttacggaccgtcggggaaccctacgggttaccacccggtttaccgtaacggttccaaccggtaccccaaaacgggccccaaaacccccgacttaccggtaccctaaccgttcccttaccgtttacccccc

SEQ ID NO: 403507 - DNA, 721 bp, Homo sapiens
  misc_feature: GZ8MTXP02JXW1B.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaagccgagggacgtccctccccagttccttcctccgtaggtacggttacgtaacggtaacctaacgtacgaagtaaacgtaaacgacggacggtcctacggtacgggtacccgtacccgacgtccgttccttccgtcgtaccggtactaaccggaaggtactacgtaccgttacccgaccgtaaccggacggtaacggtacttaacttactactactccgttcggtcggtcctacgtagttcgacggaacgtaggtacgggacgtcgttaacgtaactttacgtttaacggtttggtttacgtacgttacggaaccaaaccgtaaaccgtaaccgtccggttagtaaccgtttccggtaccggtaaccgggtaccgggacccgttacggtacccgtaccgttaccggtacgaccgaacccggaaccccgaacggaccccctaaaccccgtgttacccacccgttacttccgtcccccg

SEQ ID NO: 403508 - DNA, 506 bp, Homo sapiens
  misc_feature: GZ8MTXP02GF2ST.13.11.A11.1.454.CMB.2.raw
  modified_base (371)..(371): a, c, t, g, unknown or other
  modified_base (379)..(379): a, c, t, g, unknown or other
  modified_base (394)..(394): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagtttctcctgaggttcaggtcaaactcagaataaacgacaggctcgtggacgtccccagccgcttctctggactccaaggatgattccgacacgcaggatatacncatctcgnggctcagtctgacgntgagctgactattactgttgacttgacacaacgacgctggactcgtacggactgggaccacggtcaccgtctaggtcacgcccaagccaacccatcgacactctcgtacccc

SEQ ID NO: 403509 - DNA, 513 bp, Homo sapiens
  misc_feature: GZ8MTXP02GBGMG.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggactccaaggatgattccgcacgcagggatattactcatctctgggctcagtctgacgatgaggctagactattactgtttgacttggacacaacaacgcctggactcgttcggacctgggaccacggtcaccgtctacggtcacgcccaaggccaacccactcgcactctcgttccccg

SEQ ID NO: 403510 - DNA, 403 bp, Homo sapiens
  misc_feature: GZ8MTXP02I5421.13.11.A11.1.454.CMB.2.raw
  modified_base (217)..(217): a, c, t, g, unknown or other
  modified_base (312)..(312): a, c, t, g, unknown or other
  modified_base (332)..(332): a, c, t, g, unknown or other
  modified_base (356)..(356): a, c, t, g, unknown or other
  modified_base (390)..(403): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggacncctgaagtattttgcagtatattcctgtcacctagtttggtgactcgaacgtggacgttcggcctagtgggaccaaggtggaaaatgaaacgacnggtggctgcacatctgtctnatccttccgcatctgatagtcgtnacttgaggcgggctggacaaggtcgactagtagnnnnnnnnnnnnnn

SEQ ID NO: 403511 - DNA, 553 bp, Homo sapiens
  misc_feature: GZ8MTXP02HECBR.13.11.A11.1.454.CMB.2.raw
  modified_base (351)..(351): a, c, t, g, unknown or other
  modified_base (357)..(357): a, c, t, g, unknown or other
  modified_base (360)..(360): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagatgtattgactaacgagtatggttcctggtatcagcagaaggcaggccacgccccctgtcctactcattctttacaaaatccaggccgccctcgtcggggtccctggagcgacttcgccccggctccgctcgnggaacncgngtcactctgaccatccgacggccggacccacgcctagttgatgagctgtctacttctgtcgaggcggtgggacacgagcgtgcgttcggtcgggcggtacgggaccaggtccgtacggtaccgtcgttacggccgacgcccgaaggccgtccgcccccgtcggtccaccgttccgtccgttcccccgtccccg

SEQ ID NO: 403512 - DNA, 554 bp, Homo sapiens
  misc_feature: GZ8MTXP02HVAEI.13.11.A11.1.454.CMB.2.raw
  modified_base (355)..(355): a, c, t, g, unknown or other
  modified_base (430)..(430): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttacaaaataccaggccgccctctggggtccctgagcgattctccccggctcccgctcgtggaaccacngtcactctcgaccatcagcggacccagcctagttgattgaggctgtctacttctgtcaggcgttagggacaacgngcgtgcgttggtcggcggacgggacgtaggtcgtacggtaccgttcgtacggtcgaccgacccgaacggccgtcccgtcccccgtcggtaccctccgttcccgttccgtttaccccctaccccg

SEQ ID NO: 403513 - DNA, 381 bp, Homo sapiens
  misc_feature: GZ8MTXP02ILI8F.13.11.A11.1.454.CMB.2.raw
  modified_base (344)..(344): a, c, t, g, unknown or other
  modified_base (372)..(372): a, c, t, g, unknown or other
  modified_base (378)..(381): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaatgtggctgcaccatctgtcttcatccttcccgccatctgntgtacgtgactgagcgggctggcaaggncatagnnnn

SEQ ID NO: 403514 - DNA, 546 bp, Homo sapiens
  misc_feature: GZ8MTXP02II2IP.13.11.A11.1.454.CMB.2.raw
  modified_base (251)..(251): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagttgttttatacagctccgacaataggaactactagcttggtaccaanagaaaccaggacagcctacgaagttactctttacgtgggccgtacgtaccccgggaattcccggggtccctgaccgattccagtggcaggccgggtctgggacagtactttcactctcaccatcagccagccttacaggctagaagatggtgactagttttattactgtaccagactaaattattatactcttcctccctccgtcggtacgttccggaccgaggaccgagggtaacgaaatacgaaaacgactgtgctgacacatctgtcttcactccttccgctactctagtac

SEQ ID NO: 403515 - DNA, 534 bp, Homo sapiens
  misc_feature: GZ8MTXP02G1COU.13.11.A11.1.454.CMB.2.raw
  modified_base (401)..(402): a, c, t, g, unknown or other
  modified_base (517)..(517): a, c, t, g, unknown or other
  modified_base (524)..(524): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagcccagggacgtcctccccagtttctcctgaggttcaggtcaaactcagataaacgacaggctcgtggacgtccccagcccgcttctctggactccgaaggatgacttccgacacgcagggatattactcatctcgtggcctcgagtctgacgnngaggctagacttattacgttgtttgacttggctaacaacgaacgcctaggacttcgttcggaacgtcgggaacctacgggtccaccgtcgacggtcacgccaacggccaaccccncgtcacnctctcctccc

SEQ ID NO: 403516 - DNA, 752 bp, Homo sapiens
  misc_feature: GZ8MTXP02JPDGN.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggagtccctccccagtttcctcctgaggttcaggtacaaactcagaataaacgacgagggctacgtggaacgtccccaggcccgtctttcctcgtggactacccgaaaggatcgacttcccgacgaaccgcgaaggggtacttaacgttactacaactcgttcgtggggtccctaccgagtctaggaccgtagtcggaggtctagtaaccttagtttaccgttggttttacgaaccgtttgggaaccctaaaccgaaaaccgtaaccggtccccgttaaggggtaacctttcccggtttacccgggggaaaccccgttaccgggggtaaaccccgtacccgggggtttaccccgtaacccccggggtttacccgttaaacgggggttccccaaaaccggggtaccccccgtaaaaaccggggcccccctaaaaacccccccgtagttcccgggttaccctaaaccccggtttccctttaacccgggttttacccccccc

SEQ ID NO: 403517 - DNA, 385 bp, Homo sapiens
  misc_feature: GZ8MTXP02IATX0.13.11.A11.1.454.CMB.2.raw
  modified_base (342)..(342): a, c, t, g, unknown or other
  modified_base (378)..(385): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagctttgctactttattctgtcaccagtatggtaggtcaccgtactactttggccaggggaccaagctggagatcaagcgaactgtggctgcacatctgtctcatccttcccgcatctgntagtacgtgactgagcgggctggcaaggcgcatagnnnnnnnn

SEQ ID NO: 403518 - DNA, 350 bp, Homo sapiens
  misc_feature: GZ8MTXP02GU6FO.13.11.A11.1.454.CMB.2.raw
  modified_base (342)..(350): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcacctagtatggaactgtgctgcaccatctgtcttcacttccttcccgctatctgatagtacgtgactggagcgggtctcggacaaggcgacatagnnnnnnnnn

SEQ ID NO: 403519 - DNA, 579 bp, Homo sapiens
  misc_feature: GZ8MTXP02IIEUR.13.11.A11.1.454.CMB.2.raw
  modified_base (354)..(354): a, c, t, g, unknown or other
  modified_base (483)..(483): a, c, t, g, unknown or other
  modified_base (558)..(558): a, c, t, g, unknown or other
  modified_base (565)..(565): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggactccctccccagttcctcctgaggttcaggtacaaatcagaataaacgacagggctcgtaggacgtccccagccgcttctcgtggacctaccgaaaggntcgaacttcccgacaacgcgaaagggtaacttacttaactcaacgttctacgttcgggcctcccgaggttcctagaaccgtataggaaggctagtaaacctagtttacgttgtttagtacttggaccanaaacgacgcctaggacttctacgggacctgggaccacgtcacccgtctaacggccacgccctaaagcccaaaccnctcgacncctctccgtccccg

SEQ ID NO: 403520 - DNA, 393 bp, Homo sapiens
  misc_feature: GZ8MTXP02JEWUV.13.11.A11.1.454.CMB.2.raw
  modified_base (346)..(346): a, c, t, g, unknown or other
  modified_base (385)..(393): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtagtcaccgtacactttggccaggggaccaagctggagatcaagcgaactgtggctgcaccatctgtctccattcctcccgctatcctgntacgtacgtgactggagcgggctggcaaggcgcagtagnnnnnnnnn

SEQ ID NO: 403521 - DNA, 381 bp, Homo sapiens
  misc_feature: GZ8MTXP02G8D6R.13.11.A11.1.454.CMB.2.raw
  modified_base (377)..(381): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctacttttattctgtcaccagtatggtaggtcacgtacacttttggccaggggaccaagctggagatcaagcgaactgtggctgcaccatctgtctccatcttcccgcatctgatgtacgtgactgagcgggctggcaaggcgcatagnnnnn

SEQ ID NO: 403522 - DNA, 533 bp, Homo sapiens
  misc_feature: GZ8MTXP02JEGQ3.13.11.A11.1.454.CMB.2.raw
  modified_base (285)..(285): a, c, t, g, unknown or other
  modified_base (379)..(379): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccgacaataggaactacttagcttggtacccaacagaaaccaggacagcctcgaagttactctttacngggcctctacccgggaatcccggggtccctgaccgattcgagtggcaggcgggtctggggacagactttcactctcaccatcagcagtcccttnaggctgaagatgtggctagtttatacgtgtcagtcaatattatatctctccctctcggtacgttcgacctaagggaccaggggtagaactacaaacgaactgacggctaggcaacctactctgtcctcactccttcccgacctacttgactacg

SEQ ID NO: 403523 - DNA, 538 bp, Homo sapiens
  misc_feature: GZ8MTXP02IRUI9.13.11.A11.1.454.CMB.2.raw
  modified_base (249)..(249): a, c, t, g, unknown or other
  modified_base (284)..(284): a, c, t, g, unknown or other
  modified_base (314)..(314): a, c, t, g, unknown or other
  modified_base (330)..(330): a, c, t, g, unknown or other
  modified_base (337)..(337): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccgacaataggaactactagcttggtaccaanagaaaccaggacagcctccgaagttactctttacnggcgtctaccgggatccgggtcctgaccgnttcagtggcagcggtntgggacngactttcactctcacatcagcagcccttagaggctaggaaacgtatgtaggctaagtttattactgtcagtactaaatattatatccttctcccttctaccggtacgttccggaccgtaagggaccgagggtaaggaactacaaaacgacgtagtcggctcgacaactctctgtctcactcttacccgctactctagtacg

SEQ ID NO: 403524 - DNA, 384 bp, Homo sapiens
  misc_feature: GZ8MTXP02I8O9H.13.11.A11.1.454.CMB.2.raw
  modified_base (342)..(342): a, c, t, g, unknown or other
  modified_base (350)..(350): a, c, t, g, unknown or other
  modified_base (372)..(372): a, c, t, g, unknown or other
  modified_base (377)..(384): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttattctgtcaccagtatggtagtcaccgtacactttggcctaggggaccaagctggagatcaagcgaactgtggctgcaccatctgtcttcatctcccgcatctgntgtacgtnactgagcgggctggcaaggcgnatagnnnnnnnn

SEQ ID NO: 403525 - DNA, 512 bp, Homo sapiens
  misc_feature: GZ8MTXP02FKGPZ.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaaggatgattccgcacgcagggatatactcatctctggctcagtctgacgatgaggctagactattactgtttgactttggacacaacaacgcctaggatcttcggactgggaccacggtcaccgtcaggtcacgcccaaggcccaacccactcgtcactctcgttaccccc

SEQ ID NO: 403526 - DNA, 694 bp, Homo sapiens
  misc_feature: GZ8MTXP02G9XIQ.13.11.A11.1.454.CMB.2.raw
  modified_base (326)..(326): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagatgtattgactaacgagtatggttcctggtatcagcagaaggcacggccacgccccctgtccctactcattctttacaaactccgaggccgccctcgtcggggtcccngacgcgtacttccgcccccggtcctcccgcctcgtacgggaaccacgcgtcactcctcgaccatcgacggccggaccagtccctagtcgagtgacggtcttcgttctacgttcgtcggtcgacggggtcggttagggaacctaacgggacgtcggtcggtccggtttcggggttaccggggacggggtaacgggggtaaccgtcgggttaccggtaccgggttaaccccggtttccggtttaaacgggtacccgtaacccgggacccccggtaaacggggtcccgttaacccccggtacccccccgttacggggttcccctaaccccgtttccccgtttccccggtttacccccctttaaccccccgg

SEQ ID NO: 403527 - DNA, 539 bp, Homo sapiens
  misc_feature: GZ8MTXP02HLWBS.13.11.A11.1.454.CMB.2.raw
  modified_base (346)..(346): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctcgtggacgtccccagccgcttctcgtggactccaaggntgattccgcacgcaagggatattactcatctcgtggctcagtctgacgatgaggctagacttagttacttgtttgtacttgggactacgaaccaacgtccgtgggtactcgttcggaccttggggacccacggtccaccgtctacgggtccacggccccaaggcccaacccacgtcgcacctctcgtcccccg

SEQ ID NO: 403528 - DNA, 379 bp, Homo sapiens
  misc_feature: GZ8MTXP02GWZQP.13.11.A11.1.454.CMB.2.raw
  modified_base (252)..(252): a, c, t, g, unknown or other
  modified_base (266)..(266): a, c, t, g, unknown or other
  modified_base (350)..(350): a, c, t, g, unknown or other
  modified_base (361)..(361): a, c, t, g, unknown or other
  modified_base (373)..(373): a, c, t, g, unknown or other
  modified_base (375)..(379): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtanggtagtcaccgtanactttggccagggccaagctggagatacaagcgaactgtggctgctaccatctgttcttactcttcccgcatctgatgtacgtnactgagcgggntggcaaggcganannnnn

SEQ ID NO: 403529 - DNA, 609 bp, Homo sapiens
  misc_feature: GZ8MTXP02IVS5N.13.11.A11.1.454.CMB.2.raw
  modified_base (382)..(382): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacaagaagccagggacgtcctccccagtttctcctgaggttcaggtcaaactcagataaacgacaggctctggacgtccccagcccgcttctctggactccgaaggtatgattcccgaccacggcgaggtacttacttacnctactctcggtggcctaccgaggttctagaacgtagtggacgtctagtaacttagttttaccgttgtttacgtacgtttcggacaacctaaaccgacgtccgtaggtacttccgttacgaccggtcgggaacctacgggtaccaccggttacgtacggtcgaacccggacccgaaacggaacccccaaaccccgtattccgacctaccgttccgttcccttaccccc

SEQ ID NO: 403530 - DNA, 568 bp, Homo sapiens
  misc_feature: GZ8MTXP02I32Z3.13.11.A11.1.454.CMB.2.raw
  modified_base (330)..(330): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccacagaagccaggacgtcctccccagtttctcctgacggttcaggtcaaactcagataaacgacaggctcgtggactccccagccgtcttcnctggactccgaagactaactccgaccaacgcgagggaatagttacctcatctacgtgggcctaccagtctgaacgatggaggctagacttattacgtgtttagacctttggactaaccaaacgaaccgtccgtaggtaacttcgttaccggaaccgtcgggaaccctacgggtaccaccggtccgtaaggtccacgacccaacggcccaaacccgctcgacactcgtcctcccgtccc

SEQ ID NO: 403531 - DNA, 659 bp, Homo sapiens
  misc_feature: GZ8MTXP02IF1LC.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagttctcctgaggttcaggtcaaactcagataaacgacaggctcgtggacgtccccagccgcttctcgtggacctaccgaaggatgacttcccgacacgcgaaggtactagttacctcaattcctacgttgggccttacgaacgtctagacgagtggaacggtccttagaacttaatttaccgttggttttagtacgtttgggaccaaaccaacgaaaccgtcccgtagggtacttaccgtttccgggaccgtacggggtaaccctaccggggttccaaccccggttccgtaacggttaccgaaccggtaacccccgaaaccggggtaacccccaaaacccccgtaaccgtttccggaccgtaacccgttcccgtttaacccgtttaccccccc

SEQ ID NO: 403532 - DNA, 554 bp, Homo sapiens
  misc_feature: GZ8MTXP02HG1AZ.13.11.A11.1.454.CMB.2.raw
  modified_base (287)..(287): a, c, t, g, unknown or other
  modified_base (388)..(388): a, c, t, g, unknown or other
  modified_base (506)..(506): a, c, t, g, unknown or other
  modified_base (541)..(541): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagttgttttatacagctccgacaataggaactacttagcttaggtacaacagaaaccaggacagcctacgaagttactctttacngggccgtctacccgggaatccggggtccctgaccgattcgagtgcaggcgggtctgggacagtattcactctcaccatcagcagccttcaggctagaaagntgtggactaggtttaattacgtgtaccagtactaaattattatacttctacctcccttacgcggtacgttcggaccaagggaccgaggggtaacgaaataccgaaacgaagtgacgcncgtaccactactctgtacttcacttccttaccccnctactctagtacg

SEQ ID NO: 403533 - DNA, 513 bp, Homo sapiens
  misc_feature: GZ8MTXP02F7WFZ.13.11.A11.1.454.CMB.2.raw
  modified_base (371)..(371): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctcgtggacgtccccagcccgcttctcgtggactccaaggatgattccgcacgcagggatatacncatctctggctccagtctgacgatgaggctgacttattactgtttgacttggactacaacacgcctggatcttcggactggaccacggtcaccgtctacggtcacgcccaaggcccaacccactacgccactcgtctacccc

SEQ ID NO: 403534 - DNA, 560 bp, Homo sapiens
  misc_feature: GZ8MTXP02HDJPU.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaactcagataaacgacagggctcgtggacgtccccagccgcttctcgtggactccgaaggatgacttccgaccacgcaggggatattaactcatctcgtggctccagtctgacgatgaggctgacttattacttgtttgtacttcggactaacaaacgaaccgtcctagggacttcgttccggacctcggggaccctacggtcctaccgtccgtacgttccacgccccgaaacggccctaaaccccgacgttcaccaccttccgtacttaccccc

SEQ ID NO: 403535 - DNA, 512 bp, Homo sapiens
  misc_feature: GZ8MTXP02GDE21.13.11.A11.1.454.CMB.2.raw
  modified_base (285)..(285): a, c, t, g, unknown or other
  modified_base (508)..(508): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctcgaagttactctttacnggctctacccggatccgggtcctgaccgattcgagtggcaggcggtctgggacagtactttcactctacacatcagcacgccttcaggctagaagatgtggctagtttattactgtcagctaatattatatctctcctctcgtacgttcgaccgaggacgaggtagaaatacaaacgaactgtgctcgacacactctgtctctactccgtacccgccactctntaag

SEQ ID NO: 403536 - DNA, 669 bp, Homo sapiens
  misc_feature: GZ8MTXP02JJ1L0.13.11.A11.1.454.CMB.2.raw
  modified_base (179)..(179): a, c, t, g, unknown or other
  modified_base (199)..(199): a, c, t, g, unknown or other
  modified_base (202)..(202): a, c, t, g, unknown or other
  modified_base (238)..(238): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctnagcgtctgggaccccccggnagngtgtcaccatctcttgttctggagcagtcgaccaanagtcggggaagtaattatgctattcgtggtactacaacaacctacccgaacggaacccgccccagacctcctctactctatacgacaaactaacccgacgccggtccctcgacggggtcccctacgaccccgtacttcctcgtcggtcctaccgaagtccgtcggcctacctcaccgtccctcccgtcgccctagtcgacggtcgggtcccgtcccgggtaccgacgtagtcggacgtcgtagtactttacttacgttcgttacgagttcgttagggatacgacgtacgtcctagtaacgtttacggtttcggggtttacgggacgggtaacgggtaaccgtaacgggttaccggacccgtacccggttacggtaccgaaccggtacccgtaacggtcccgtacccggtacccccgttacggtacctaccg

SEQ ID NO: 403537 - DNA, 383 bp, Homo sapiens
  misc_feature: GZ8MTXP02GTPSJ.13.11.A11.1.454.CMB.2.raw
  modified_base (379)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagactttgctactttattctgtcaccagtatggtagtcaccgtacacttttggccaggggaccaagctggagatcaagcgaactgtggctgcaccatctgtctccatcttcccgcatctgatagtacgtgactgagcgggctggcaaggcacatagnnnnn

SEQ ID NO: 403538 - DNA, 380 bp, Homo sapiens
  misc_feature: GZ8MTXP02INZWL.13.11.A11.1.454.CMB.2.raw
  modified_base (342)..(342): a, c, t, g, unknown or other
  modified_base (370)..(370): a, c, t, g, unknown or other
  modified_base (376)..(380): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacactttggccagggaccaagctggagatcaagcgaactgtgctgcacatctgtcttcatccttcccgcatctgntagtacgtgactgagcgggctgcaggcncatagnnnnn

SEQ ID NO: 403539 - DNA, 559 bp, Homo sapiens
  misc_feature: GZ8MTXP02ISM1V.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttcctctctgcttctcctggagcgtcagccagtctcacctgcaccttgcgcagtggcaccaatgttggtccctatgacatatattggtaccgacagaagccaggagtcctcccagtttctcctgagttcaggtcaaactcagataaacgacagggctctgggacgtcccagccgtcttctctcgactccaaggatgacttcccgccgaacgccaggggacttagttactcatctcgtgggtctccagttctagacgagtgaacggctagacttatttacttggttttagacgtttgggactaacgaacaacgcctagggtactacgttcgaccttacgggaccaacggtcaccgtccgtacggtccacgacccgaaggaccccaacccacgtcgtacctactccttcccg

SEQ ID NO: 403540 - DNA, 623 bp, Homo sapiens
  misc_feature: GZ8MTXP02GD4WQ.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctcccctagtttcctcctggacggttcaggtcaaactcagataaacgacgagggctcgtggacgtccccagcccgtcttctcgtggactaccgaaggatcgacttcccgaccacgcgaaggggtatacgttactcattctcgtggcctcgagtctgacgagtgaggctagtacttagttacttgtttcgtacgttcgggactaaacgaaaccgaccggtcctagggacttccgttacgggaccgtacggggaacctaccgggtacctaccggtaccgtacgggtaccaccggacccgaaaccggaaccccctaaaaccccgtacgtaccgtacctaaccgttcccgttaccgtttacccccc

SEQ ID NO: 403541 - DNA, 554 bp, Homo sapiens
  misc_feature: GZ8MTXP02HDVTZ.13.11.A11.1.454.CMB.2.raw
  modified_base (322)..(322): a, c, t, g, unknown or other
  modified_base (349)..(349): a, c, t, g, unknown or other
  modified_base (351)..(351): a, c, t, g, unknown or other
  modified_base (379)..(379): a, c, t, g, unknown or other
  modified_base (400)..(400): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtccctactcatctttacaaaataccaggcgcctcgtggggtccctgancgattctcccggctccgctctggaacncngtcactctgaccatcgagccgggacccngtacctagtagagtaggcgtntcgtacttacttcgtcgcgtaggcggtacgaacaaggcgcgtgtcgttgggtccggagggacgacgtacgtcgtccgtaccgttcgttaccggactaccggaccgtacgccgtccccgtcccgtcggtacctctccgttcccgtcccctccccg

SEQ ID NO: 403542 - DNA, 557 bp, Homo sapiens
  misc_feature: GZ8MTXP02HJDBN.13.11.A11.1.454.CMB.2.raw
  modified_base (370)..(370): a, c, t, g, unknown or other
  modified_base (376)..(376): a, c, t, g, unknown or other
  modified_base (388)..(388): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggatcctccccagtttctcctgaggttcaggtcaaactcagataaacgacagggctcgtggacgtccccagccgcttctctggactccaaggatgattccgcacgcgaggatattacncatctntggctccagtcngacatgagctagactattactgtttgtacttggcaacgaacaacgcctaggactcgttaccggaccgtcgggtacccacgggtccaacccggttccgtaacgggtccaaccggaccccaaacgggccccaaacccccgtactcgtaccaccttccgtcgtttacccccc

SEQ ID NO: 403543 - DNA, 530 bp, Homo sapiens
  misc_feature: GZ8MTXP02GE4WK.13.11.A11.1.454.CMB.2.raw
  modified_base (393)..(393): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggactccaaggatgattccgcacgcagggatagttactcatctcgtggctccagtctgacgntgaggctgactattactgttgacttggactacaacaacgcctaggactcgttcggaccttgggaccacgggtccaccgtcctaggtccacgcccgaaacggcccaaaccccactcgtccacgtcctcgtttaccccc

SEQ ID NO: 403544 - DNA, 382 bp, Homo sapiens
  misc_feature: GZ8MTXP02I12AF.13.11.A11.1.454.CMB.2.raw
  modified_base (338)..(338): a, c, t, g, unknown or other
  modified_base (340)..(340): a, c, t, g, unknown or other
  modified_base (375)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtagtcaccgtacactttggccaggggaccaagctggagatcaagcgaactgtggctgcaccatctgtctcatctccgcatcngntagtactgactgagcgggctggcaaggcgcatagnnnnnnnn

SEQ ID NO: 403545 - DNA, 555 bp, Homo sapiens
  misc_feature: GZ8MTXP02GUPQX.13.11.A11.1.454.CMB.2.raw
  modified_base (236)..(236): a, c, t, g, unknown or other
  modified_base (463)..(463): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataatggcagataaatntacttctggtatcagcagaagtcaggccagtccctgtgctggtcatctatcaagatgaccaagtccggccctgagggactccccccgtgaacgcgtattctcgtcggcctaccaactcgtagggaacctgacgcccaacgtctagaccatccaggaccggggaccccagggcctagtcggatggaggtctaggaccttattacgtgtaccgagggtcgtagggaccnggacagcacgtcgccccgtatacgtcgtacgttacggaacgtcggggaaaccacggttaccgacccggtactaaacgtccgacgaacccccg

SEQ ID NO: 403546 - DNA, 390 bp, Homo sapiens
  misc_feature: GZ8MTXP02GGX15.13.11.A11.1.454.CMB.2.raw
  modified_base (347)..(347): a, c, t, g, unknown or other
  modified_base (384)..(390): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttccatccttcccgccatctgntagtacgtgacctgagcgggctggcaaggcgcatagnnnnnnn

SEQ ID NO: 403547 - DNA, 549 bp, Homo sapiens
  misc_feature: GZ8MTXP02I810Y.13.11.A11.1.454.CMB.2.raw
  modified_base (346)..(346): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagtttctcctgaggttcaggtcaaactcagataaacgcaggctcgtggacgtccccagccgcttctctggactccgaaggntgacttccgcacgcagggatattactcgatctctgggctcagtctgacgatgaggtctagacttattactgtttgacttggactaacaacaacgcctaggaacttccgtcggaccgtcgggacctacggtccaccgtacctacgggtccaacgcccgaaacggccctaaaccccgacgtcgtaccaccttctccgttaccccc

SEQ ID NO: 403548 - DNA, 510 bp, Homo sapiens
  misc_feature: GZ8MTXP02H24EE.13.11.A11.1.454.CMB.2.raw
  modified_base (498)..(498): a, c, t, g, unknown or other
  modified_base (509)..(509): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctttgcttctcctggagcgtcagccagtctcacctgcaccttgcgcagtggcaccaatgttggtccctatgacatatattgtaccgacagaagccagggagtcctccccagttctcctgaggttcaggtacaactcagataaacgacagggctctggagtccccagccgcttctctggatccccaaggatgacttccgccaacgcagggatattactcatctctgggctccagtctgacgatgaggctgactattactgtttgactttgcacaacaacgcctggatcttcggactggaccacggtcaccgtctaggtcacgacccaaggccaacccactgtaccnctctctacccnc

SEQ ID NO: 403549 - DNA, 618 bp, Homo sapiens
  misc_feature: GZ8MTXP02IDBJ0.13.11.A11.1.454.CMB.2.raw
  modified_base (347)..(347): a, c, t, g, unknown or other
  modified_base (412)..(412): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatatggtaccgacagaagccagggacgtccctcccctagtttcctccgtggtacggttcaggtacaaactcaagaactaaacgacgagggctcgtagggacgtccccagccgtcttccncgtacggactaccgaaggatagacttcccgccaaacgcgaaggtattaacttacactactctcgnggtcctacgagtctagacgatgagctagactattactgtttagacttggactaacgaaacgaacgtccgtaggtacttcgttacggaccgttcgggaaccctacgggtaccacccggttccgttacgggtacccaaccggaccccgaaaccgggaccccctaaaacccccgtcgtacccggtaacctaccctttccgttcccccgg

SEQ ID NO: 403550 - DNA, 587 bp, Homo sapiens
  misc_feature: GZ8MTXP02I78K1.13.11.A11.1.454.CMB.2.raw
  modified_base (190)..(190): a, c, t, g, unknown or other
  modified_base (505)..(505): a, c, t, g, unknown or other
tcagtcacgtactacacgaccggtgctcgatttagctacgactgcaggggctgggcctcaggaggcagcatcggaggtgcctcagccgtggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccacgccccctgtcctactcatctttacaaaatccaggccgcctcgtcggggtccctgacgcgtattccgtccggccctcccgcctcgtacgggaaccacgtacgtccactctacgaccctaatccgaacgggcccggggacccacggtcccttaagttcgagttggacggtcttgttaccttacgttctgtcgagggcggtacgggacaacgaggcgtgcgttggtcgggcggtacggacngtcgtcggtaccgtgttacgggcacggcccgaagtcccgtcgcccccgtcggtcctacctcgtccgttcccctaccttcccg

SEQ ID NO: 403551 - DNA, 543 bp, Homo sapiens
  misc_feature: GZ8MTXP02IWD1T.13.11.A11.1.454.CMB.2.raw
  modified_base (199)..(199): a, c, t, g, unknown or other
  modified_base (243)..(243): a, c, t, g, unknown or other
  modified_base (265)..(265): a, c, t, g, unknown or other
  modified_base (424)..(424): a, c, t, g, unknown or other
tcagtcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccgaaggggaaangccaccctctcctgcagggccagtcagattgtcagcagcaactnttagcctggaccagcagagccnggccacggcccccaggcctcctcatctacgatgtatcgaggagaccatgacactcccagacaggtcagtcggcaggtggtctggggacagtccttcactctacacctatcagacagactacggaaccgtagaaagtactttcgacttactttattcgtntacctactagtagttaggtacgtctacgtactacgtttcggacgtacggggacagtcgtaggtagatacgaagacgaacgtgacgctacgcaccgtatctcgtaccttactacttcccg

SEQ ID NO: 403552 - DNA, 585 bp, Homo sapiens
  misc_feature: GZ8MTXP02F85ZN.13.11.A11.1.454.CMB.2.raw
  modified_base (273)..(273): a, c, t, g, unknown or other
  modified_base (353)..(353): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacaggaagccagggactccctccccagtttcncctgagttcaggtacaactcagataaacgacagggctcgtggacgtccccagcccgtcttctcgtggacctccgaaggtntcgtacttcccgacctacggcgaagggtatagttacctcatctcgtggcctccgagtctgacgatgaggtctagacttattacgttgtttacgacttcggacaacaaaccgacgtcgtaggtacttcgttaccggacgtacgggacctacggtacctacccgttcgaacggtccacgaccccgtaaacggcccctaaaaccccgcttccgactacctcttcccgttaccccc

SEQ ID NO: 403553 - DNA, 627 bp, Homo sapiens
  misc_feature: GZ8MTXP02GYY3B.13.11.A11.1.454.CMB.2.raw
  modified_base (334)..(334): a, c, t, g, unknown or other
  modified_base (349)..(349): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccgagggacgtccctccccagtttcctcctgaggttcaggtacaactcagataaacgacgaggctcgtggactcccagcccgcttcnctggactaccaaggntgactccgaccacgcgagggtatattactctatctcgtggtcctacgagttcctagacgtagtggacggctacgtacttagtttaccgttgtttagacgtttagggacctaaccaaacgtaaccgccgttaaggacttccgttaccgggaccgtcgggaacccctacgggtacccaacccggttccgtaacgggtacccaccggaaccccgaaaccggaaccccctaaacccccgacgttaccgtcccaaccgtttcccgttaccggtttcccccccg

SEQ ID NO: 403554 - DNA, 387 bp, Homo sapiens
  misc_feature: GZ8MTXP02GV6VF.13.11.A11.1.454.CMB.2.raw
  modified_base (243)..(243): a, c, t, g, unknown or other
  modified_base (347)..(347): a, c, t, g, unknown or other
  modified_base (384)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctggggacagacttcactctcaccatcagcagactggaacctgaaagctttgctactttattcngtcaccagtatggtaggtcaccgtacacttttggcctaggggaccaagctggagatcaagcgaactgtggctgcaccatctgtcttccatcttccgccatctgntagtacgtgacctgagcgggctggcaaggcgcatagnnnn

SEQ ID NO: 403555 - DNA, 389 bp, Homo sapiens
  misc_feature: GZ8MTXP02GRU1N.13.11.A11.1.454.CMB.2.raw
  modified_base (347)..(347): a, c, t, g, unknown or other
  modified_base (384)..(389): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtcaccgtactactttggccaggggaccaagctggagatcaagcgaactggtggctgcaccatctgtcttccatccttcccgcatctgntagtacgtgactgaggcgggctggcaaggcgcatagnnnnnn

SEQ ID NO: 403556 - DNA, 523 bp, Homo sapiens
  misc_feature: GZ8MTXP02FY3EA.13.11.A11.1.454.CMB.2.raw
  modified_base (402)..(402): a, c, t, g, unknown or other
  modified_base (450)..(450): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggacgtccctccccagttctcctgaggttcaggtcaactcagataaacgacaggctctggacgtccccacgccgcctctctggactccgaagatgacttcccgaccacgacgagggatattactcatctctgggcctccagtctgacgntgaggctagacttattacgtgttgacttggacaacaacacgcctggancgttcggacctgggaccacggtcaccgtctagtcacgcccaacggccaaccccatcgtccactctacgtcccc

SEQ ID NO: 403557 - DNA, 611 bp, Homo sapiens
  misc_feature: GZ8MTXP02F4UMR.13.11.A11.1.454.CMB.2.raw
  modified_base (386)..(386): a, c, t, g, unknown or other
  modified_base (475)..(475): a, c, t, g, unknown or other
  modified_base (562)..(562): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgcttattttaaaaggtgtccagtgtgaggtgcagctggtagagtcgtgggggaggtgtggtacggccgtggggggtccctcagactctcctgtgcaacctctggattcagtatttgatgagtatggcatacacgtgggtccaccaaccgtccgaggggaagggctggcgaggtgggtctcgtaggtaataaacgtggaatgggtgaccagacaactaaacttntgcaagtactcgtggtagaaacggggtccctaattccaccaagttccaccgaagacgtacaggtccgaccgaagtaaccttcccgaaanccttgacggaactaaaaagtcgaaacgtacgttccgaaggggacgtacggagggaaccctacgggtccttttaggtaacttttcggnggtcggacggttaggtagcgtaggtcggtcgttagtaactacgacgtag

SEQ ID NO: 403558 - DNA, 340 bp, Homo sapiens
  misc_feature: GZ8MTXP02HX2SL.13.11.A11.1.454.CMB.2.raw
  modified_base (241)..(241): a, c, t, g, unknown or other
  modified_base (331)..(340): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtctttgctatttattcngtcacagtatggaactgtgctgcaccatctgtctcatctcccgcatctgatagtacgtgactgacgcgggctcggcaaggcgactatagnnnnnnnnnn

SEQ ID NO: 403559 - DNA, 637 bp, Homo sapiens
  misc_feature: GZ8MTXP02GZIE3.13.11.A11.1.454.CMB.2.raw
  modified_base (272)..(272): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtccctatgacatatattggtaccacagaagccagggacgtccctcccgagtttccnccgtgtaggttcaggtacaaactcaagaataaacgacgagggctcgtgggaccgtccccagccgtcttcgtcgtcggactccgaaaggtactcggacttcccggaccgaaacggcgaaggggtacttaacgttactacctattctacgtcgggtacctccgtagtacgtacggacgaatggaaggtcctagtaacttagtttacgttgtttagacttggaccacgaaacgacgtcctaggtacttcgtacgggaccttacggggaccctacgggtacctaccggtccgttacggaccgaccggaccccgaaacgggccccctaaaacccctacgttccgtacctacccgttccgtttaacccccg

SEQ ID NO: 403560 - DNA, 335 bp, Homo sapiens
  misc_feature: GZ8MTXP02HOCTW.13.11.A11.1.454.CMB.2.raw
  modified_base (330)..(335): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtattttgctacttttattctgtcaccagtatggaactgtggctgcaccatctgtctcatcctccgcattgatagtacgtgactgagcggctggccaaggcgcatgnnnnnn

SEQ ID NO: 403561 - DNA, 513 bp, Homo sapiens
  misc_feature: GZ8MTXP02JYSSV.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctcgtggacgtccccagccgcttctctcggatccaaggatgacttccgccaacgcagggatatactcatctctgggctccagtctgacgatgagctgactattactgtttgacttggctacaacgacgcctggattcgttcggacctcgggaccaggtccaccgtcacgcacgcccgaaggcccaacccgctcgacacgtctccg

SEQ ID NO: 403562 - DNA, 513 bp, Homo sapiens
  misc_feature: GZ8MTXP02JR723.13.11.A11.1.454.CMB.2.raw
  modified_base (366)..(366): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctctggagtccccagccgcttctctggactccaaggatgattccgcacgcagggatatacncatctctgggctccagtctgacgatgaggctgactattactgttgacttggcacaacaacgcctggatcgttcggacctgggacccacggtcaccgtccgtacggcacgacccaggcccaaacccactcgcacctctcgttcccccg

SEQ ID NO: 403563 - DNA, 394 bp, Homo sapiens
  misc_feature: GZ8MTXP02FZXL0.13.11.A11.1.454.CMB.2.raw
  modified_base (389)..(394): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactacgttttggccaggggaccaagctaggagatcaagcgaactgtggctgcaccatctgtcttccatccttcccgctatctgatacgtacgtgactgagcgggctggcaaggcgacatagnnnnnn

SEQ ID NO: 403564 - DNA, 542 bp, Homo sapiens
  misc_feature: GZ8MTXP02HZWGT.13.11.A11.1.454.CMB.2.raw
  modified_base (193)..(193): a, c, t, g, unknown or other
  modified_base (329)..(329): a, c, t, g, unknown or other
  modified_base (368)..(368): a, c, t, g, unknown or other
  modified_base (370)..(370): a, c, t, g, unknown or other
  modified_base (438)..(438): a, c, t, g, unknown or other
  modified_base (454)..(454): a, c, t, g, unknown or other
  modified_base (479)..(479): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccacccctccatcgtccgtcgtcccccgganagacagcctacatcacctgctctggagatgtattgactaacgagtatggttcctggtatcagcagaaggcacggccacgccccctgtccctactcattctttaacaaactccgaggccgccctcgtcggggtcccnggacgcgacttccgccccggctcccgctcgtaggaaccncncgtccactctacgacctagcgacgcccgacccacgcctagtgagtgacgtctcgtctacttctgtcgnggcgtaggacacgagngtcgcgtcggtcggcggacggacgngtcgacgtccgtctacggcacgccgacggcctccgccctcggtctccgtctccgttcctcccg

SEQ ID NO: 403565 - DNA, 398 bp, Homo sapiens
  misc_feature: GZ8MTXP02HDTEG.13.11.A11.1.454.CMB.2.raw
  modified_base (389)..(389): a, c, t, g, unknown or other
  modified_base (391)..(398): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcacagtatggtagtcaccgtacactttggccaggggaccaagctggagatcaagcgaactgtggctgcaccatctgtcttccatccttcccgcctatctagtagtacgtgacctgacggcggggctgggcaagggccgcgataggngnnnnnnnn

SEQ ID NO: 403566 - DNA, 537 bp, Homo sapiens
  misc_feature: GZ8MTXP02J0SG4.13.11.A11.1.454.CMB.2.raw
  modified_base (384)..(384): a, c, t, g, unknown or other
  modified_base (479)..(479): a, c, t, g, unknown or other
  modified_base (520)..(520): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggactcctccccagtttcctcctgaggttcaggtacaaactcaagataaacgacgagggctcgtggacgtccccagccgcttctctggactaccgaaggatgacttcccgccaaacgcagggatattacncatctcgtggcctacgagtctgacgagtgaggctgacttattcgttgttgacttggacaacaacgacgtctaggattccgtcggacgtcggaccncggtcaccgtcgtagtccacgacccaacggaccccaacccnctcgcctactctacccg

SEQ ID NO: 403567 - DNA, 596 bp, Homo sapiens
  misc_feature: GZ8MTXP02ITF9S.13.11.A11.1.454.CMB.2.raw
  modified_base (212)..(212): a, c, t, g, unknown or other
  modified_base (287)..(287): a, c, t, g, unknown or other
  modified_base (319)..(319): a, c, t, g, unknown or other
  modified_base (336)..(336): a, c, t, g, unknown or other
  modified_base (342)..(342): a, c, t, g, unknown or other
  modified_base (382)..(382): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttanacagctccgaacaataggaactactagcttggtaaccaacagaaaccaggacagcctccgaagttactctttacnggccgtctacccggatccgggtccctgaccgnttcagtgcagcgggtcngggacngactttcactctcaccatcagcacgccttcaggctgaagntgtggcagtttatactgtcagactaatattatatccttctccctccttccgggacgtttccggacccgaaaggggtacccgtaggggttaaacggaaattaaccgaaaacggtaaccgttggtacgggtccttacggaccctaacctaacttaccgttcgtttccttaaccgtaccttcccgtttacccccgctaaactttccttaggtaaacg

SEQ ID NO: 403568 - DNA, 541 bp, Homo sapiens
  misc_feature: GZ8MTXP02HCHXT.13.11.A11.1.454.CMB.2.raw
  modified_base (211)..(211): a, c, t, g, unknown or other
  modified_base (288)..(288): a, c, t, g, unknown or other
  modified_base (357)..(357): a, c, t, g, unknown or other
  modified_base (366)..(366): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttanacagctccgacaataggaactacttagcttaggtaaccaacagaaaccaggacacgcctacgaagttactctttacnggctctacccggatccgggtcctgaccgattcgagtgcagcggtctggacagctttcactctcacatcngcagccttnaggtctagaacgagtgtcggtactagtttacttactgtcagtactaaatattatatcttactccctccgtcggtacgttcggaccgaagggaccgagggtaggaaactacgaaaacgactaggcggctacggcaaccgtctcgtcgtactcgtactcctccactactctagtacg

SEQ ID NO: 403569 - DNA, 666 bp, Homo sapiens
  misc_feature: GZ8MTXP02J07OS.13.11.A11.1.454.CMB.2.raw
  modified_base (244)..(244): a, c, t, g, unknown or other
  modified_base (270)..(270): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccganagagcagggactccctccctagttcncctgacgttcaggtacaaactcagaataaacgacgagggcctcgtcggacgtccccgaggtcccgtcttctcgtcggactaccgaaggatcgtactcccgactacggcgtaagggtacttacgttacctctactcgtacgtcgggtcctaccgtagttctacgtacgtagtacggacgtccgttagtaactttagtttaccgttggtttacgacgtttacggaacctaaccgaaacgtaccggtccgttagggtacctttccggttaccgggacccgttacgggaaccccgtacggttacccgacccggtttaccgtacggtaccacccggaacccgtaaccggaacccccaaacccgtacgtaccgtacctaccgttccctacccgttacccccg

SEQ ID NO: 403570 - DNA, 550 bp, Homo sapiens
  misc_feature: GZ8MTXP02JENEZ.13.11.A11.1.454.CMB.2.raw
  modified_base (338)..(338): a, c, t, g, unknown or other
  modified_base (354)..(354): a, c, t, g, unknown or other
  modified_base (387)..(387): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagagccgaggagtccctccccagtttcctcctgacggttcaggtccaaactcagaataaacgacaggctcgtcggacgtccccagcccgtcttcncgtgactccaaggatnacgggttccaccacggcaggggatagttacctnactctcgtggcctcagtctgacagtgagctagacttattacttgtttcgacgttggacaacaacgacgccgtaggactccgttcggaccgttcgggaccacggtccaccggtcctacggtcacgcccaacgcccaacccacgtcacacgtcctacgtaccccc

SEQ ID NO: 403571 - DNA, 384 bp, Homo sapiens
  misc_feature: GZ8MTXP02HV98A.13.11.A11.1.454.CMB.2.raw
  modified_base (240)..(240): a, c, t, g, unknown or other
  modified_base (337)..(337): a, c, t, g, unknown or other
  modified_base (368)..(368): a, c, t, g, unknown or other
  modified_base (373)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaagactttgctactttattcngtcaccagtatgtagtcacgtacactttggccagggaccaagctggagatcaagcgaactgtggctgcacatctgtctccatcttcccgcatctagntagtacgtgactgagcggctggcaaggccgnagtgnnnnnnnnnnnn

SEQ ID NO: 403572 - DNA, 491 bp, Homo sapiens
  misc_feature: GZ8MTXP02FPXFQ.13.11.A11.1.454.CMB.2.raw
  modified_base (287)..(287): a, c, t, g, unknown or other
  modified_base (425)..(425): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagccagccagagtgttttatacagctccaacaataagaacttcttagcttggtaccagcagaaacccaggacagcctcctaagctgctcatttacngggcatctatccgggaatccggggtccctgaccgattcagtggcacgcgggtctgggacagatttcactctcaccatcagcagcctgcagctagaagatggtgctagtttatactgtcagcaatattatagtactccncgtagctcacttcggcgacggccaaggtgagacgacaaacgacgtgtgctgacacgactctgttac

SEQ ID NO: 403573 - DNA, 386 bp, Homo sapiens
  misc_feature: GZ8MTXP02HT28U.13.11.A11.1.454.CMB.2.raw
  modified_base (343)..(343): a, c, t, g, unknown or other
  modified_base (381)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaaagtactttgctacttttattctgtcaccagtatggtaggtcaccgtacactttggccagggaccaagctggagatcaaagcgaactgtggctgcacatctgtctcatcttcccgctatctgntagtacgtgactgacgcgggctgcaaaggcgcgatagnnnnnn

SEQ ID NO: 403574 - DNA, 540 bp, Homo sapiens
  misc_feature: GZ8MTXP02GPZ5V.13.11.A11.1.454.CMB.2.raw
  modified_base (264)..(264): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccatgtgtcctatgacatatattggaccgacagaagccaggagtcctcccagtttcncctgaggttcaggtcaaactcagataaacgacagggctctggacgtcccagccgcttctctggactccaaggatgacttccgccgaacgcgagggatattactcatctcgtcggctcgagtctagacgatgaggctgaacttattacgtgtttgacttggacaacgtaacacgtccgtaggactccgttcggaccgtacggggacccgtacggtccaacccggtctaacgggtccaacgcccgaacggccccaacccacgtctaccacttctcccg

SEQ ID NO: 403575 - DNA, 506 bp, Homo sapiens
  misc_feature: GZ8MTXP02F0NQB.13.11.A11.1.454.CMB.2.raw
  modified_base (373)..(373): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctcccagtttctcctgaggttcaggtcaaactcagaataaacgacaggctctggacgtccccagccgcttctctcggactccaaggatgattccgccaacgcagggatattacncatctcgtggctccagtctgacgatgagctgactattactgttgattggcacaacacgctggatcgtcgactcggaccacggtcaccgtctacggtcacgcccgaaggcccaacccgactcgtacactctccg

SEQ ID NO: 403576 - DNA, 515 bp, Homo sapiens
  misc_feature: GZ8MTXP02IBK2N.13.11.A11.1.454.CMB.2.raw
  modified_base (407)..(407): a, c, t, g, unknown or other
  modified_base (409)..(409): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctcgacaataggaactacttagcttggtaccaaacagaaaccaggacagcctccgaaagttactctttactggcgtctacccgggaatcccggggtcctgaccgattcagtggcagcgggtctgggacagactttcactctcacatcagcagcccttcaggctagaagatgtggcagtttatactgtctananaatatatatctctctctcgtacgtcgcgacgacgaggagaagtacaaacgaacgtacgtagcgtacgacacactactctctctactactcctcctactactactag

SEQ ID NO: 403577 - DNA, 335 bp, Homo sapiens
  misc_feature: GZ8MTXP02IDZCL.13.11.A11.1.454.CMB.2.raw
  modified_base (242)..(242): a, c, t, g, unknown or other
  modified_base (324)..(324): a, c, t, g, unknown or other
  modified_base (330)..(335): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagctttgctactttatttcngtcacagtatggaactgtggctgcaccatctgtcttcatcttcccgcatctgatagtacgtgactgagcggctggcaaggcncatagnnnnnn

SEQ ID NO: 403578 - DNA, 636 bp, Homo sapiens
  misc_feature: GZ8MTXP02JVN0H.13.11.A11.1.454.CMB.2.raw
  modified_base (244)..(244): a, c, t, g, unknown or other
  modified_base (274)..(274): a, c, t, g, unknown or other
  modified_base (340)..(340): a, c, t, g, unknown or other
  modified_base (356)..(356): a, c, t, g, unknown or other
  modified_base (385)..(385): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgttgactcagccgtcttccctctctgcttctcctggagcgtcagccagtctcacctgcaccttgcgcagtggcaccaatgttcggtccctatgacatatattggtaccganagaagccgaggggactccctcccagtttcncctgaggttcaggtacaaactcaagataaacgacagggctcgaggaccgtccccgagccgtcttcnctggactccccgaagntgactccgaccaacgcgaggatacttacncacttctcgtgggcctccgagtcctagacgtatgggacggtctagtacttatttacgttgtttacgaacgtttcgggactaaaccgtaaacgaacccggtccgttagggtaacctttcgggttcccgggaaccgttcgggggaaccccttaccgggtacccgtacccggttccgtaacgggccaaaccggacccccgaaacggccccaaaccccgtactccgtacccaccttcctccgttaccccctaccc

SEQ ID NO: 403579 - DNA, 592 bp, Homo sapiens
  misc_feature: GZ8MTXP02GMAXH.13.11.A11.1.454.CMB.2.raw
  modified_base (238)..(238): a, c, t, g, unknown or other
  modified_base (296)..(296): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagaataaatntacttcctggtatcagcagaagtcaggccagtcccctgtgctggtcatctatcaaagntgaccaagccggccctagagggactcccccgtgaacgcgtattcactcgggcctaccaaactcgtagggaaacctcgagccctacgtccacgacccataccgaaggacccgggaccccagggacctaagtacggagtagagggactacgtacttaagttaacgtcgtaccgaagggtcggtaggggaaccaggacgaacggtcaaccgttcggaccccgttcttaacgttcgttaccgtacggtaacgtacgggaaccgtacggtaccgtaccgtacgtaacgccgaaccgacccg

SEQ ID NO: 403580 - DNA, 687 bp, Homo sapiens
  misc_feature: GZ8MTXP02HTU58.13.11.A11.1.454.CMB.2.raw
  modified_base (363)..(363): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtggcaccaatgttggtccctatgacatatattcggtaccgacaagaacgccgagggacttccctccctagtttcctcctaggtaggttaccaggtacaaactcaagaactaaacgacgagggctcgtgggactcccagccgtctctctggactccgaaggntcgtacttccgctaacgcagggtattacgttactctactccgtacgtcgggtctaccgagttcgtagaccgtagtacgggacgctacggtaactttaacgtttacgtttcggtttttagaccgtttacgggaaccttaaaccgaaaccgtaacccggtaccgttacgggtaaacctttccgttaccggggtaacccggtttacgggaacccggttaccgggtaccctaacccgggttacctacgggtaccgaacccgggtacccgaaaacgggcccccgtaaaaccccctacgtaccggtaccctaccgtttcccgtttccccg

SEQ ID NO: 403581 - DNA, 545 bp, Homo sapiens
  misc_feature: GZ8MTXP02IU58M.13.11.A11.1.454.CMB.2.raw
  modified_base (333)..(333): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgtcttccnctggactaccaaggatgacttccgccacgcaagggactattactcatctctgggactccagtctgacgatgaggctgacttattactgtttacgtacgttggcaactaacaacgcctagggacttcgtcggtactcgggaccgacggtcaccgtccgtacgggtcacgcccaaggcccaaccccgacttcgacctactcgttcgttaccccc

SEQ ID NO: 403582 - DNA, 590 bp, Homo sapiens
  misc_feature: GZ8MTXP02IYUOJ.13.11.A11.1.454.CMB.2.raw
  modified_base (382)..(382): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtcctccccagtttcctcctgacggttcaggtacaactcagaataaacgacaggctcgtggacgtccccagccgtcttctctggactccgaaaggtctgacttccgaccacgcgagggatattcncatcctcgtggccttcgagtctgacgatgaggtctgtaacttagttacgttggtttgtaccgttaggcaacgaaactaccgccgtaggtactccgttacggacgtcgggacccaggtaccgaccgttaccgtaggtccgaccgtaccccgaacggaaccccctaacccggtacttcggtaccctacctttccggttcccttcccccgg

SEQ ID NO: 403583 - DNA, 598 bp, Homo sapiens
  misc_feature: GZ8MTXP02G8WEM.13.11.A11.1.454.CMB.2.raw
  modified_base (311)..(311): a, c, t, g, unknown or other
  modified_base (416)..(416): a, c, t, g, unknown or other
  modified_base (568)..(568): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccagggagtcctccccagtttctcctgaggttcaggtcaaactcagataaacgacagggctcgnggacgtccccagccgtacttctctaggacctaccgaaggtatcgacttcccgaccacgcgaaggggtattacttacctcagtcctcgtcgggcctaccgagttcngacgatgaggctagacttattacgttgtttacgtcttacgggtacaacgaaaccaacgtccgtagggtaacttcgttaccggaccgtacggggacctaccgggttacacccgttccgtacggtccgacgccccgaaaggccccgaaaccccncgtcgtaccaccgttccgtactttaccccc

SEQ ID NO: 403584 - DNA, 512 bp, Homo sapiens
  misc_feature: GZ8MTXP02GYQ45.13.11.A11.1.454.CMB.2.raw
  modified_base (261)..(261): a, c, t, g, unknown or other
  modified_base (305)..(305): a, c, t, g, unknown or other
  modified_base (332)..(332): a, c, t, g, unknown or other
  modified_base (392)..(392): a, c, t, g, unknown or other
  modified_base (449)..(449): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcccnccccagtttctcctgaggttcaggtcaaactcaagataaacganaggctctggacgtccccagccgcttcnctggactccaaggatgattccgcacgcagggatatactcatctctggctccagtctgacntcgagctgacttattactgttgacgttgactacaacacgctaggactcgtacggacnggtaccacggttcaccgtctacggtcacgccaacgcctaacccacttcgacactctcgtcccc

SEQ ID NO: 403585 - DNA, 616 bp, Homo sapiens
  misc_feature: GZ8MTXP02IV73A.13.11.A11.1.454.CMB.2.raw
  modified_base (274)..(274): a, c, t, g, unknown or other
  modified_base (337)..(337): a, c, t, g, unknown or other
  modified_base (353)..(353): a, c, t, g, unknown or other
  modified_base (390)..(390): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttccncctgaggttcaggtacaaactcagaataaacgacagggctcgtggactccccagccgctttcnctggactccgaaaggntcggaacttcccgaccacggcaaggggtactattacncattctcgtgggcctaccgagtctgacgtatggaggctagaacttattacgttgtttagtacttgggaccaaacaaacgaaccgtccgtaggtaacttccgttacgggaccgttacggggaaccctacggggtaccacccggttaccgtacgggtccaacggaccccgaaacggaacccccaaacccctacgtacgtacctaccttaccttcccggtttaaccccc

SEQ ID NO: 403586 - DNA, 534 bp, Homo sapiens
  misc_feature: GZ8MTXP02I1N2F.13.11.A11.1.454.CMB.2.raw
  modified_base (235)..(235): a, c, t, g, unknown or other
  modified_base (462)..(462): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgaaataatggcagataaatntactcctggtatcagcagaagtcaggccagtcccctgtgctggtcatctatcaagatgccaagcggcctcagggactccccctgagcgattctctggctccaactcgtaggggaactcgaacgccctacgtctcgacccatccgagccgggacccaggctaagtggatggaggtctaggtacctattacgtgtacgtaggcgtgggacaggcaagcaacgtgcccgntacgtcgtaccgttacggaacttacggggaaccctaaagggtcctaccggtacctaacggtcaacgaccccg

SEQ ID NO: 403587 - DNA, 680 bp, Homo sapiens
  misc_feature: GZ8MTXP02IL7BO.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccatgttgtcctatgacatatattcggtaccgacagagccgagggacgtccctccccagtttcctccgtgtacgttcaggtacaaactcagaataaacgacgaggctcgtggacgtccccagccgtcttctcgtggacctaccgaaaggctacgacttcccgaccacggcgaagggtacttacttactcgacttcctcgtcgggcctaccgagtccgtagacgtagtacggaacgggtctaggtaactttagtttacgtttaggttttacggtaaccgtttcgggacctaaaaccgtaaaccgtaaaccggtcccgttagggtactttaccggttcccggggaacccgttcggggaacccctacggggttacccgaacccggttaccgtaaacggtcccgaaccgtaccccgaaaccggaaccccctaaacccgtacgtcgtacctacccttccgttacccggtttccccccg

SEQ ID NO: 403588 - DNA, 384 bp, Homo sapiens
  misc_feature: GZ8MTXP02G0WKH.13.11.A11.1.454.CMB.2.raw
  modified_base (216)..(216): a, c, t, g, unknown or other
  modified_base (378)..(384): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggancctgaagactttgcacttttattctgtcaccagtatggtaggtcacgtacactttggccaggggccaagctggagatcaagcgaactgtggctgcaccatctgtcttcatcctcccgcactctgatagtacgtgactggagcgggctggcaaggcgcatagnnnnnnn

SEQ ID NO: 403589 - DNA, 579 bp, Homo sapiens
  misc_feature: GZ8MTXP02GVFJR.13.11.A11.1.454.CMB.2.raw
  modified_base (213)..(213): a, c, t, g, unknown or other
  modified_base (290)..(290): a, c, t, g, unknown or other
  modified_base (395)..(395): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagttgttttanacagctccgaacaataggaactacttagcttggtaaccaacagaaaccaggacagcctacgaagttactctttacgnggccgtacgtacccgggaatcccggggtccctgaccgtattcgagtggcaggcgggtctgggacagtacttcactctcaccatcagcagccttgaggctagaagntgtgactagtttatactgcagactaattatatatcgttctccctcgtcggtacgttcgaccgtaaagggaccgtagggtacgaaaatacgaaaacgtacgtgtacgggactcgacctaacctacttccgttcgttacccttaacgtactttcccgtaccccgacctaacttccgttagtaaacg

SEQ ID NO: 403590 - DNA, 380 bp, Homo sapiens
  misc_feature: GZ8MTXP02F8JEK.13.11.A11.1.454.CMB.2.raw
  modified_base (374)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctacttttattctgtcaccagtatggtaggtcaccgtacactttggccaggggaccaagctggagatcaagcgaactgtgctgcaccatctgtctcatcttccgcatctgatgtacgtgactgagcgggctggcaaggcgcatagnnnnnnn

SEQ ID NO: 403591 - DNA, 387 bp, Homo sapiens
  misc_feature: GZ8MTXP02FXWPK.13.11.A11.1.454.CMB.2.raw
  modified_base (383)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttcccgcctatctgctagtacgtgacctgagcggggctgcaaggcgcatagnnnnn

SEQ ID NO: 403592 - DNA, 582 bp, Homo sapiens
  misc_feature: GZ8MTXP02HS5OE.13.11.A11.1.454.CMB.2.raw
  modified_base (345)..(345): a, c, t, g, unknown or other
  modified_base (375)..(375): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttgtcctatgacatatattggtaccacagaagccagggactccctcccagttctcctgaggttcaggtacaaactcagaataaacgacgaggctcgtggacgtcccagccgcttctcgtaggactaccgaaggntcgacttccgacacgcagggtactattacnattctcgtaggcctacagtctagacgatggaacggtctagtaacttatttacgtgtttcgtacgttgactaaacgaaacgacgcgtggacttcgttacggacgtcgggaactaccggtacaccgttacgtaacggtccgaacgaccccgaaacggaaccccctaacccgtacttacggtaccctacctccgtttacccgttaccccc

SEQ ID NO: 403593 - DNA, 553 bp, Homo sapiens
  misc_feature: GZ8MTXP02JRJ6K.13.11.A11.1.454.CMB.2.raw
  modified_base (338)..(338): a, c, t, g, unknown or other
  modified_base (370)..(370): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccacgccccctgtccctactctatcctttacaaaatccgaggccgtccctcgtcggggtccctgacgcgattccnccccggtcctcccgcctcgtagggaaccacgngtccactcctgaccatcgacgccgggacccagtcctatgatgagctagtctacttgtgtcgaggcggtgggacacgagcgtgcgttggtcggcgggagggacctaggtcgtcggaccgtcgttacggccacgcccgaacggcctccgccccgtcggtccaccgtccttccgtcccctaccccg

SEQ ID NO: 403594 - DNA, 581 bp, Homo sapiens
  misc_feature: GZ8MTXP02G9TMI.13.11.A11.1.454.CMB.2.raw
  modified_base (275)..(275): a, c, t, g, unknown or other
  modified_base (392)..(392): a, c, t, g, unknown or other
  modified_base (419)..(419): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaattgttggtccctatgacatatattggtaccgacagaagccgagggactccctcccagtttccncctgaggttcaggtacaaactcaagaataaacgacgagggctcgtggacgtccccagcccgtcttctcgtcggactccgaaggatcgacttcccgacaacgcgaagggtatattacncatctcgtacggctccgagtcagacgntgagctagtacttattactgtttagacttggacaacgaacacgccgtaggtacttcgttacggaccgtacgggaccctacggtcctaccgttccgtacggtaccaacgtacccgaaaccggcccccaaaaccccgtcgtaccgtaccaccgttccttccccg

SEQ ID NO: 403595 - DNA, 625 bp, Homo sapiens
  misc_feature: GZ8MTXP02FKFAI.13.11.A11.1.454.CMB.2.raw
  modified_base (190)..(190): a, c, t, g, unknown or other
  modified_base (476)..(476): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttctggtatcagcagaaggcaggccacgccccctgtcctactcatctttacaaactccgaggccgtccctcgtcggggtccctgacgcgtacttccgtccccgggtcctcccgctcgtacggggaaccacgtgtccaactctacgaccatccgacgccgggacccagtccctagttgagtggacggtctcgtccttacgttcgttggtccgagggtccggttaggggaccaaacggnggtccggtgtcgttcggggttccggggcggggtaacggggacctacgttccggtaggtacccggtttcggtaacggtccgaacggaccccgaaggtcccgtccgtcccccgtcggtaccctaccttccgtacccgtttcccctaccccg

SEQ ID NO: 403596 - DNA, 570 bp, Homo sapiens
  misc_feature: GZ8MTXP02IGY4L.13.11.A11.1.454.CMB.2.raw
  modified_base (201)..(201): a, c, t, g, unknown or other
  modified_base (391)..(391): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctcggggacccccgggnagagtgtcaccatctcttgttctggaggcagtgccaacatcggggataattatgcattctggtatcaacaactcccaggaccggcccccagactcctcatctatagacaataaccagccggcccctcgacggggtccctgaccccgtattcctctggctccagtctggcaccctcacgcctcctgcccancagtgggacctccggtccgacgatgacggctgatttagttactgttcagtcgttaggatggactagtcctagtaacttacggtttgggttttacgggacggtacgggaccttaaaggtccgaccgacccgttggtaccaacggtacccaaggtcctccggcccccgttaggtcctaccg

SEQ ID NO: 403597 - DNA, 545 bp, Homo sapiens
  misc_feature: GZ8MTXP02I6VOH.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaactcagataaacgacaggctctggacgtcccagccgcttctctggactccaggatgacttcccgaccacgccaaggggtatacgttactcatctcgtgggtcctcgagtctgacgatgagtctgactattactgtttcgacttggactaacaacacgtccgtggtaacttcgttacggaccgttgggacctacggtccacccggtcctacgggtccacgcccgaacggcccaacccactacgacacctctcttaccccc

SEQ ID NO: 403598 - DNA, 553 bp, Homo sapiens
  misc_feature: GZ8MTXP02GCIZM.13.11.A11.1.454.CMB.2.raw
  modified_base (379)..(379): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcaagtctcacctgcaccttgcgcagtggcaccaatgttggtccctatgacatatattggtaccgacagaagccagggacgtccctccccagtttctcctgaggttcaggtcaaactcaagataaacgacaggctcgtggacgtccccagccgcttctcgtggacctccgaaggatcgacttcccgcacgcagggatattacncatctctgggctccagtctgacgatgaggctagacttatttactgtttgacgtttggactaacaaaccgaacgcgtaggtactccgttacggaccgtcgggaccgtacggtccaccgtccgtacggtccgacgcccgaaacggcccaacccactcgtaccactctcgttacccc

SEQ ID NO: 403599 - DNA, 745 bp, Homo sapiens
  misc_feature: GZ8MTXP02H0LJP.13.11.A11.1.454.CMB.2.raw
  modified_base (305)..(305): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaggtgtccagtgtgaggtgcagctggtagagtcgtgggggaggtggtggtacggccgtggggggtccctcgagactctcctgtgcaacctctggattcagtatttgatgagtatggcatacacgtgggcccnccaaccgtccgaggggaaggggctgcgaggtgggtctcgtaggtaataaacgtggtaaagtggggtagcccgaaggacctaaaccgtaaactttagtcggactaagtaacccttcgttaggggtacgtaaacggggggcccctaaagttcccaaaccctaacttcccgtacccgaaaggaacgaaccgtaagggttcggacccggtaaaacgtaaacccgttcccccggtaaatacgttacccgtaggaaacccaaaagttagaaaaacccgtcggttacccgtacggggaaccgttaccgggaaacgggaaccctaaccggggttcccttttagggtttaacttttccggtagggttacggtaccggttaaggggtttacgccggtaaaggttcgggtcccgttaaggggtttaaccctttaacgggaccttaaagggg

SEQ ID NO: 403600 - DNA, 415 bp, Homo sapiens
  misc_feature: GZ8MTXP02IEOJM.13.11.A11.1.454.CMB.2.raw
  modified_base (402)..(415): a, c, t, g, unknown or other
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcaggtgggtctgggacagacttcactctcaccatcagcagactggaacctgaagtctttgcttactttatttctgtcaccagttatggtagtcaccgtactacgtttggccgaggggaccaagcgtggagatcaagcgaacgtggtgctgcacatctgtcttccacttccttccccgctatcctagtctagtacgtgactggacggcgggctggacaaggtcgctagagnnnnnnnnnnnnnn

SEQ ID NO: 403601 - DNA, 656 bp, Homo sapiens
  misc_feature: GZ8MTXP02JWNF3.13.11.A11.1.454.CMB.2.raw
  modified_base (200)..(200): a, c, t, g, unknown or other
  modified_base (238)..(238): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctcggggacccccggnagagtgtcaccatctcttgttctggaggcagtgccaanatcggggagtaattatgcattctggtatcaacaactcccaggaaccggccccagacctcctcatctatagacaataaccagccgcctcgacggggtccctgaccccgattctctggcctaccaagtctggcctacctcacgtccctcccgtcgggccctatcccgagggtcgggcccgttcccggggtacccgacggtacgtcgggacgggtacctaggttaatttactttaacgttacggttcgtaacggttccggtttagggggattacggaacgtacgtacccgttaggtaaaacgtttacgggtttcgggggttttaccgggacggggtaacggggtacccgtaaaggttccggacccgtaccgtacggtccaacggtcccgaacggtccgtccggcccccgtcggtactcccg

SEQ ID NO: 403602 - DNA, 406 bp, Homo sapiens
  misc_feature: GZ8MTXP02F7A28.13.11.A11.1.454.CMB.2.raw
  modified_base (399)..(406): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcaggtgggtctgggacagacttcactctcaccatcagcagactggaacctgaaagtctttgactacttttattctgtcaccagtatggtaggtcaccgtactacgttttggccgtagggaccaagcgtaggagatcgaagcgaatggtgctgcacatctgtctccatccttcccgcctatctgtactagtacgtgactgacgcgggctgggacgaaggcgacagtagnnnnnnnn

SEQ ID NO: 403603 - DNA, 500 bp, Homo sapiens
  misc_feature: GZ8MTXP02F12IX.13.11.A11.1.454.CMB.2.raw
  modified_base (330)..(330): a, c, t, g, unknown or other
  modified_base (355)..(355): a, c, t, g, unknown or other
  modified_base (441)..(441): a, c, t, g, unknown or other
  modified_base (454)..(454): a, c, t, g, unknown or other
  modified_base (461)..(461): a, c, t, g, unknown or other
  modified_base (477)..(477): a, c, t, g, unknown or other
  modified_base (487)..(487): a, c, t, g, unknown or other
  modified_base (497)..(497): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtccctactcatctttacaaaatccaggcgccctgtcggggtccctgagcgattccnccccggctccgctctgggaaccacngtcactctgaccatcagccgggaccagcctattcgatgaggctgtctacttctgtcaggcgtgggacaacgagcgtgctggtcggnggagggccagtcngaccgtntaggcagcccaggccnccgccctgcnctctcgtccnccg

SEQ ID NO: 403604 - DNA, 388 bp, Homo sapiens
  misc_feature: GZ8MTXP02JNUY2.13.11.A11.1.454.CMB.2.raw
  modified_base (242)..(242): a, c, t, g, unknown or other
  modified_base (345)..(345): a, c, t, g, unknown or other
  modified_base (382)..(388): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattcngtcaccagtatggtaggtcaccgtacactttggccaggggaccaagctggagatcaagcgaactgtggctgcaccatctgtctccatccttcccgctatctgntagtacgtgactgagcgggctggcaaggcgcagtagnnnnnnn

SEQ ID NO: 403605 - DNA, 675 bp, Homo sapiens
  misc_feature: GZ8MTXP02GAPBJ.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttcggtcctatgactatatattggtaccgacagaagccgaggacgtcctcccagtttcctcctgaggttcaggtcaaactcagaataaacgacaggctcgtggactcccgagccgcttctctcggactccgaaggatcgacttccgccgaaacgcgaagggtactacgttaactcacttcctcgtcggggtacctaccgagttcttacggaccgtagttcggacgggccttaggtaaacctttagtttaaccgtttggttttacgacgttttacgggacctaaaaccgaaaccgtaaccggtccgttacggggtacttaccggtttaccgggaacccgttacgggggaaaccccttaaccggggtacccgtaaacccggtccgtttacgggtaccaccggaccccgaaacgggtacccccaaaccccgtactccggtacctacccgttccgtttcccccggg

SEQ ID NO: 403606 - DNA, 385 bp, Homo sapiens
  misc_feature: GZ8MTXP02J3I4U.13.11.A11.1.454.CMB.2.raw
  modified_base (256)..(256): a, c, t, g, unknown or other
  modified_base (321)..(321): a, c, t, g, unknown or other
  modified_base (342)..(342): a, c, t, g, unknown or other
  modified_base (381)..(385): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcacctagtttggngactcaacgtggacgttcggccatgggaccaaggtggaaatgaaacgactgtggctgcaccatcngtcttcatcttcccgcatccngatgtacgtgactgcgcggggctggcaaggcgacatagnnnnn

SEQ ID NO: 403607 - DNA, 614 bp, Homo sapiens
  misc_feature: GZ8MTXP02FGLI9.13.11.A11.1.454.CMB.2.raw
  modified_base (261)..(261): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggatcccnccccagtttctcctgaggttcaggtacaaactcagataaacgacagggctcgtggacgtccccaggccctacttctccgtggacctaccgaaaggatggacttcccgaccaacggcgaagggtattattacctcaattccgtcgtggggtccctaccgagttcctagacgatggaggtctagtaacttaattacgtgtttacgacgtttcgggacaacaaaccgaacgccttagggtactccgttacggaccgtacgggacctacgggtaccctaaccgtctacgggtaccaacgcccgaaaacggccccaaaaccccgtactacgtacctactcccgtccggtttccccccg

SEQ ID NO: 403608 - DNA, 733 bp, Homo sapiens
  misc_feature: GZ8MTXP02J2HJF.13.11.A11.1.454.CMB.2.raw
  modified_base (192)..(192): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatcgtccgtgtccccccgganagacagcctacatcacctgctctggagatgtattgactaacgagttatggttcctggtatcagcagaaggcaggccacgccccctgtcctactcattctttacaaactccgaggccgccctcgtcggggtccctgacgcgtacttcctccccggcctccgcctcgtacggggaaccacgacgtccacttcctgaacccagtccgacgggcccggggaaccccagtccccgttaattcggaacgttcgggacggtccgttcggttacctttaccgttcgttacggttccgacggggtccggttaggggaaccaaacgggtacggcccgttgggtaccgttcgggggtttaccgggacgggggaccggggtaaccccgtagggttcccgtacgggtaaccccggttccggttttaaacggggcccgtaccggggacccccgtaaacgggggttcccccgttaacccgggtccccccccggtttacggggttacccctaacccggtttccccgtttacccggtttacccccccgtttacccccg

SEQ ID NO: 403609 - DNA, 613 bp, Homo sapiens
  misc_feature: GZ8MTXP02HBUGX.13.11.A11.1.454.CMB.2.raw
  modified_base (272)..(272): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttcncctgagttcaggtcaactcagataaacgacaggctcgtggacgtcccagccgcttctcgtggactccgaaggatgacttccgacacgcagggatagtactcatctcgtggctccagtctgacgtatgaggctagacttagttacttgtttagtaccttgggacaacaaacgaaccgtccgtagggtaacttccgtttaccgggaccgttacggggaaccccgtacgggttaccaacccggttaccgtaacgggttccaaccggtaccccgaaaccgggaacccccaaaacccccggttactaccggtacctaacccgttccgtttcccggtttcccccccg

SEQ ID NO: 403610 - DNA, 637 bp, Homo sapiens
  misc_feature: GZ8MTXP02GG9YT.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccacaagaagccagggacgtccctcccctagttcctcctgaggttcaggtacaaactcagaataaaacgacgaggctcgtggacgtccccagccgtcttctcgtggactaccgaaggatgacttcccgacacgcgagggtaatacttactacatctcgtgggtcctcgagtctgacgatgaggctagacttattacttgtttacgtacgttaggacaaacaaaccgaaccgtccgtaggtacttccggttaccgggaccgttaccggggaacccgtaccgggttaccaacccggttaccgttaacgggtacccgaaccggacccccgaaaaccgggaacccccaaaacccccgtaccgttacggtaccctaaccgttcccttacccggtttaaccccccc

SEQ ID NO: 403611 - DNA, 659 bp, Homo sapiens
  misc_feature: GZ8MTXP02GIX1H.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttccctggagcgtcagccagtctcacctgcaccttgcgcagtggcaccaatgttgtcctatgacatatattggtacacagaagccgaggacgtccctcccagtttctcctgaggttcaggtacaaactcagaataaacggacagggactcgtggacgtcccccagccgtacttctcgtggactacccgaaggatgacttccgaccaacgcgagggaattaattacctctaatccttcgtcgggtcctaccgtaacgtctacggaaccgtaagtggaacgggtctcgtaaacttaacgtttaacctttggtttacgtaacttggaccaaacctaaacaaccggactagtagggtacttccggttaccggtaccgtacggggacccgtaaaccggttcctaacccggttaccccgttaagggtcccaacggacccctaaaacgggaacccccaacccctaaccgtcgtaccctaaccgttccttacccggtttaacccccc

SEQ ID NO: 403612 - DNA, 652 bp, Homo sapiens
  misc_feature: GZ8MTXP02H1VRC.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggacgtccctcccctagtttcctccgtgacggttcaggtacaaacgtcagaactaaacgacaggctcgtggacgtccccagccgtcttctctggacctaccgaaagggtatacgtaacttcccggaccaacggccgaaaggggtattactttaacctcaattcctcgtggggtccctcccgtagtccctagggaactagtggaacggtctaggtaaccttagtttacttggtttttagacgtttcgggaccaaacgaacgaaccgtcgttaagggctttaccgttcgggacccttcggggaaccctacgggttccacccggtacttacgggccaaccgacccgaaacggtccccaaaaccccgtactttcggaccctaccgtttccgtaccgttccccc

SEQ ID NO: 403613 - DNA, 564 bp, Homo sapiens
  misc_feature: GZ8MTXP02HU0U9.13.11.A11.1.454.CMB.2.raw
  modified_base (218)..(218): a, c, t, g, unknown or other
  modified_base (233)..(233): a, c, t, g, unknown or other
  modified_base (359)..(359): a, c, t, g, unknown or other
  modified_base (539)..(539): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagntgtattgactaacgngtatggttctggtatcagcagaaggcagccacgccccctgtcctactcatctttacaaaatccaggcgccctcgtcggggtccctgacgcgattccgtccccggctcccgctcgtagggaaccacncgtcactctacgaccatccgacgccgggacccagtccctaagttgaattggacggtctgtccttacttctggtccgagggtcgtagggacaacgagcgtgtcgtggtccggcgggacgggacaggtcgtggtaccgtcgtacggtcaccgcccgaaggcctccgtcccccgtcggtaccncgtttccgtccgttccccgtccccg

SEQ ID NO: 403614 - DNA, 620 bp, Homo sapiens
  misc_feature: GZ8MTXP02JTK6B.13.11.A11.1.454.CMB.2.raw
  modified_base (217)..(217): a, c, t, g, unknown or other
  modified_base (305)..(305): a, c, t, g, unknown or other
  modified_base (429)..(429): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagacctccctggctgtgtctctgggcgaggagggccaccatcaactgacaagaccagccagagttgttttaanacagctaccgaacaataggaactacttagcttaggtacccaacaagaaaccaggacagccctaccggtaaagttaccttcttttacgnggggtaccgtccgtaaccccggggagtcccggggtccctggacccgtattcgaggtgggcaggcgggtacgtggggacagtaccttcactcctcaccatcagcacgtcctagagctagaaagtntggtaggacttagtttatacgtgtacagtactaaattacttaatattcctaccgttccctaccgtcgggtaccgttccggaaccgtaaggggacccgaggggtaacgaaataccggaaaacgtacgtggtacggctacgacccactacgtcttcgttactcacgttcccgtcccgactacttcgagtaacg

SEQ ID NO: 403615 - DNA, 545 bp, Homo sapiens
  misc_feature: GZ8MTXP02I7ZRZ.13.11.A11.1.454.CMB.2.raw
  modified_base (346)..(346): a, c, t, g, unknown or other
  modified_base (374)..(374): a, c, t, g, unknown or other
  modified_base (379)..(379): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagtttctcctgaggttcaggtcaactcagataaacgacaggctcgtggacgtccccagccgcttctcgtggactccgaagntagattcccgacacgcgaggatattacnatctntgggctcagtctgacgatgaggctgacttattacgttgtttgacttggacaacaacgacgtacctggtacttccgttacggccgtacggggaccacggtcacccgtcgtacggtcacgtcccgaacggcccaaacccgacttcgaccaccttcgttccgtcccccg

SEQ ID NO: 403616 - DNA, 383 bp, Homo sapiens
  misc_feature: GZ8MTXP02IWZHH.13.11.A11.1.454.CMB.2.raw
  modified_base (244)..(244): a, c, t, g, unknown or other
  modified_base (307)..(307): a, c, t, g, unknown or other
  modified_base (362)..(362): a, c, t, g, unknown or other
  modified_base (377)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaacctgaaagtctttgctacttttattcngttcaccagtatggtagtcaccgtacactttgccaggggaccaagctgagatcaagcaactgngctgcaccatctagtctcatcttcccgcctatctgctagtactgactgagcgggntgcaaggcgcatagnnnnnnn

SEQ ID NO: 403617 - DNA, 389 bp, Homo sapiens
  misc_feature: GZ8MTXP02F3YD2.13.11.A11.1.454.CMB.2.raw
  modified_base (381)..(389): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtactactttggcaggggaccaagctggagatcaagcgaactgtggctgcactatctgtcttccattccttcccgccatcctgctagtactgactgagcggctggcaaggcgcatagnnnnnnnnn

SEQ ID NO: 403618 - DNA, 735 bp, Homo sapiens
  misc_feature: GZ8MTXP02IJ9M7.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggactcctcccagtttcctcctgacggttcaggtacaaactcaagaataaacgacagggctcgtgggacgtcccagccgtcttcgtctggactccgaaggtactgtacgttcccgccgaaaccgtacgaggggtaacttacttaacctctaactccttacgtcggggtctcccgagttcccgttaggaccgtaagttacggaagggtcctaggtaactttaacgtttaaccgtttggtttttacgacgttttacgggaccctaaacgtaaaacccgtaaaccggtcccgttaggggtaaccttccggtttacccgggtaaaaccccgggttcggggtaaacccccggttaccgggtacccgttaaacccccggggttaccgttaacccggggttacccgaaccgggtacccccgaaaccggggtacccccaaaacccccgtcgttaaccggtcccctaaaccgtttccgtttccccccggg

SEQ ID NO: 403619 - DNA, 701 bp, Homo sapiens
  misc_feature: GZ8MTXP02I9U9N.13.11.A11.1.454.CMB.2.raw
  modified_base (217)..(217): a, c, t, g, unknown or other
  modified_base (370)..(370): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccggacagacagcctacatcacctgctctgganatgtattgactaacgagtatggttcctggtatcagcagaaggcaggccacgcccctgtccctactcattctttacaaaactccacggccgccctcgtcggggtccctggacgtcgtacttccgccccggcctcccgcctcgtgggaacctacngtccactctcgaccctatccgacggcccgggaccctacgacccttagtagagtggacgtcttcggttaccttacgttcgttaggtccgtaggggtaccggttagggacccgtaacggaacggtccggttacggtccggttcggggttaccggggacggggtaacggggtacccgtaacgggttccgttacgggtacccggtttacgggttaacgggttacccgaaccgggttacccccgaaacggggtccccgttaacccggtcccccccgtttacggggtccccctaacccggtttcccgtttccccggtttaacccccgtttccccccg

SEQ ID NO: 403620 - DNA, 594 bp, Homo sapiens
  misc_feature: GZ8MTXP02GDR7W.13.11.A11.1.454.CMB.2.raw
  modified_base (299)..(299): a, c, t, g, unknown or other
  modified_base (372)..(372): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaggtgtcagtgtgaggtgcagctggtagagtcgtgggggaggtgtggtacggccgtgggggtccctcagactctcctgtgcaacctctggattcagatttgatgagtatggcatacactgggtccnccaacctccgagggaaggggctgcgagtgggtctctggtataaacgtggaatggtcgccagcaacaaactttngacagtactcgtagaggaacggcctataccactatccgacgaagagacagtacgaccgaagtaaacctccgtaactacttcagaactaaaagtacgaacgtacgtcgtacgggacgtacggaacggtaccgtacggttctttagttactttcgttacgtacggtacggtacggttacggtaacgtacggtacggtacgtacggttacgttacgtacgtaacg

SEQ ID NO: 403621 - DNA, 542 bp, Homo sapiens
  misc_feature: GZ8MTXP02I34VU.13.11.A11.1.454.CMB.2.raw
  modified_base (287)..(287): a, c, t, g, unknown or other
  modified_base (510)..(510): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccgacaataggaactacttagcttggtaacccaacagaaaccaggacagcctacgaagttactctttacngggctctacccgggaatccggggtcctgaccgattcagtgcaggcgggtctgggacagtctttcactctcaccatcagcagccttgaggctagaagatggtggctagtttatactgtcagctaaatattatatcttctccttccgtacggacgttcgacccgaaaggggaccaggggtagaaactacgaaaacgaacttggcggctacggaccacctatcctnttcttcacttccttacccgctactctagtacg

SEQ ID NO: 403622 - DNA, 371 bp, Homo sapiens
  misc_feature: GZ8MTXP02FKLRW.13.11.A11.1.454.CMB.2.raw
  modified_base (369)..(371): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagactttgcacttttattctgtcaccagtatggtagtcaccgtacacttttggccaggggccaagctggagatcaagcgaactgtgctgcacatctgtctcatctccgcatctgatgtactgactgagcgggctggcaaggcgcatagnnn

SEQ ID NO: 403623 - DNA, 382 bp, Homo sapiens
  misc_feature: GZ8MTXP02FXVAY.13.11.A11.1.454.CMB.2.raw
  modified_base (377)..(382): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtcaccgtacactttggccaggggaccaagctggagatcaagcgaactgtggctgcacatctgtctccatccttcccgcatctgatagtacgtgactgagcgggctgcaaggcgcatagnnnnnn

SEQ ID NO: 403624 - DNA, 573 bp, Homo sapiens
  misc_feature: GZ8MTXP02GIF6D.13.11.A11.1.454.CMB.2.raw
  modified_base (192)..(192): a, c, t, g, unknown or other
  modified_base (474)..(474): a, c, t, g, unknown or other
  modified_base (501)..(501): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtcccgtcgtcccccgganagacagccagcatcacctgctctaggaaataaattggcagataaatatactctggtatcagcagaagtcaggccagtcccctgtcgctgtcatctatcaagatcgaccaaggccggccctcgacgggactcccgtgacgcgtattccgtctcggcctccgaaacgttcgttacggggaacctcgacgccctactcgtacgaacccatccgacggcccgggaacccagggaccttaagtgggaattggaacggtcgtagtaccttagttaccgtgtcgacggnggtaggaccgagacagcactcgcccgnttacgtcgtacgttaccggaacgtcgggaaaccaacggtcccgaccgtactacgaccacgacccgaaaccgg

SEQ ID NO: 403625 - DNA, 522 bp, Homo sapiens
  misc_feature: GZ8MTXP02FND4C.13.11.A11.1.454.CMB.2.raw
  modified_base (237)..(237): a, c, t, g, unknown or other
  modified_base (293)..(293): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctggaaataatggcagataaatntacttctggtatcagcagaagtcaggccagtcccctgtgctggtcatctatcaagntgccaagcggcccctgagggactcccccctgacgcgattctctgggcctccaactctaggggaacctcgacgccactctacgaccatcagccggacccaggcctagtggatggaggctgactattactgtcgaggcgtgggacagcagccacgtcgccccgtgtactcgtccgttacggaacgtcggggaaccctaaggtccacccggtactaacgtcacgaacccccg

SEQ ID NO: 403626 - DNA, 575 bp, Homo sapiens
  misc_feature: GZ8MTXP02G3URO.13.11.A11.1.454.CMB.2.raw
  modified_base (314)..(314): a, c, t, g, unknown or other
  modified_base (548)..(548): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggactccctccccagtttctcctgaggttcaggtcaaactcagataaacgacagggctcgnggacgtccccagcccgtcttctcgtggacctaccgaaggatagacttcccgaccacgcgaagggattagttacctacatctcgtcggcctccagtctgacgatggaggctagacttagttactgtttagacttggaccaacaacacgtccgtaggacttccgtacggaccgtcgggaccctacgggtccaccggtcgttacggtccgaccgacccgaaacggccccaaaccccncgtacgccacttccgtccgttaccccc

SEQ ID NO: 403627 - DNA, 576 bp, Homo sapiens
  misc_feature: GZ8MTXP02IDNRK.13.11.A11.1.454.CMB.2.raw
  modified_base (192)..(192): a, c, t, g, unknown or other
  modified_base (219)..(219): a, c, t, g, unknown or other
  modified_base (485)..(485): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtcccgtcgtcccccgganagacagcctacatcacctgctctgganatgtattgactaagagtatggttcctggtatcagcagaaggcaggccacgccccctgtcccctactcattctttacaaaactccgaggccgcccctcgtcggggtccctgacgcgattcgccccggctcccgcctcgtggaaccacagtccactcctcgacccagtccaggcccggaccacgcctattcgatggacgtcttacgtctacttctgtccgaggcgtgggacacgagcgtcgcgttgggtccggacgggtacgggaccncggtcgtacgcccgttacgttaccggacacgacccgaagggcctcccggtcccccgtcggttccaccgttcctccgttaccccctaccccg

SEQ ID NO: 403628 - DNA, 526 bp, Homo sapiens
  misc_feature: GZ8MTXP02HL9H7.13.11.A11.1.454.CMB.2.raw
  modified_base (343)..(343): a, c, t, g, unknown or other
  modified_base (368)..(368): a, c, t, g, unknown or other
  modified_base (508)..(508): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacaggctctggatccccagccgcttctctggactccgaaggntgattccgcacgcaaggatattacncatctcgtgggctcagtctgacgatgaggctagacttattactgtttgacttggcaacaacaacgcctaggactcgttacggaccgttcgggaccacggtccaccggtcctacggtcacgacccgaacggcccaaacccnctcgcactctacgtcccc

SEQ ID NO: 403629 - DNA, 572 bp, Homo sapiens
  misc_feature: GZ8MTXP02FY9A8.13.11.A11.1.454.CMB.2.raw
  modified_base (292)..(292): a, c, t, g, unknown or other
  modified_base (385)..(385): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagttgtttatacagctccgacaataggaactacttagcttaggaaccaacagaaaccaggacagccctaccgaagttacctcttttacgngggccgtccgtaaccccggggaagtcccggggtccctgacccgtattcgagtggcaggtcgggtctggggacagtactttcactctcacatcngcacgtccttacgaggtactaggaagatggtggacttaagtttatactgtacagactaaatattatactcctctcctcgtcggtacgttcggaccgaagggctagggtacgaaatacaaacgactggtacggactcggtacaccgtatctcgttactctacttcccttcccgactactcgtataacg

SEQ ID NO: 403630 - DNA, 527 bp, Homo sapiens
  misc_feature: GZ8MTXP02H6IZS.13.11.A11.1.454.CMB.2.raw
  modified_base (227)..(227): a, c, t, g, unknown or other
  modified_base (273)..(273): a, c, t, g, unknown or other
  modified_base (333)..(333): a, c, t, g, unknown or other
  modified_base (348)..(348): a, c, t, g, unknown or other
  modified_base (373)..(373): a, c, t, g, unknown or other
  modified_base (391)..(391): a, c, t, g, unknown or other
  modified_base (458)..(458): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatganatatattggtaccgacagaagccgagggagtccctccccagtttcncctgaggttcaggtcaaactcagataaacgacaggctcgtggacgtcccagccgtcttcnctggactaccgaagntgactccgccacgcgaggatatacncatctcgtggctcagtcngacgatgaggctgacttattcttgtttgacgttggacacaacacgctgatccgtcgacgtcggaccncggtaccaccgtctacgttcacgcccaacggcccaaccccgtactacgtacaccgttctacttaccccc

SEQ ID NO: 403631 - DNA, 707 bp, Homo sapiens
  misc_feature: GZ8MTXP02G6G5A.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccgacagaagccgagggacgtcctccccagttctcctgaggttcaggtacaaactcaagataaacgacaggctcgtggacgtccccagccgtcttctcgtggactccgaaaggactaggacttcccgacgaaccggccgaaaggggtaattacttaactctaattcctcgttcgggaccttccgaagtcccttagaccgtagtcgaacgggtcctagaacttaatttaacgttgtttacggtacgttcgggaccaaccgaaaaccgtaaaccggcccgtttaggggaactttcccgtttaccgggggaaccccgttacgggggaaccccttaaccgggtttaccccaaccccggttacccgttaacgggggttcccaaaaccgaccccccggaaaacgggtaacccccaaaaaccccccggctttacccggtaccctaaccggtttccccttacccggtttccccccccg

SEQ ID NO: 403632 - DNA, 387 bp, Homo sapiens
  misc_feature: GZ8MTXP02HA65V.13.11.A11.1.454.CMB.2.raw
  modified_base (344)..(344): a, c, t, g, unknown or other
  modified_base (346)..(346): a, c, t, g, unknown or other
  modified_base (381)..(387): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactactttggccaggggaccaagctggagatcgaagcgaactgtggctgcaccatctgtctccatcctcccgcatcngntagtctgactgagcgggactggcaaggcgcatagnnnnnnn

SEQ ID NO: 403633 - DNA, 688 bp, Homo sapiens
  misc_feature: GZ8MTXP02F65II.13.11.A11.1.454.CMB.2.raw
  modified_base (192)..(192): a, c, t, g, unknown or other
  modified_base (379)..(379): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctctggagatgtattgactaacgagtatggttcctggtatcagcagaaggcaggccacgccccctgtccctactcattcctttacaaaactccgaggccggcccctcgtcggggtccctggacgcgtacttccgtccccggcctcccgccgttcgtacgggaaacccncgtacgtccaacctcgtaccgaaccctacgtcgacggacccggggacccacggtccctaagttggagtggacggtcttacggttccttacgttcgttcggtcgaacggggtcgggttacggggaaacctaacggacggtccgggttcggtcggttacggggttccgggggacggggtacggggacccctaggggttaccgtcggggtacccggttcggttaacggggtcctaccggacccgaacggtcccgtcccggtacccccgtcggttaccctcccgtttccgtacccgtttacccccgtaccccg

SEQ ID NO: 403634 - DNA, 527 bp, Homo sapiens
  misc_feature: GZ8MTXP02JIJ3L.13.11.A11.1.454.CMB.2.raw
  modified_base (449)..(449): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcaggaaataaattggcagaataaatatacttcctggtatcagcagaagtcaggcccagtcccctgtgctggtcatctatcaagatgccaagccggccctcgagggactcccccgtgagcgattctctggcctccaactcgtacggggaactcgagccactctacgaccatccagccgggacccaggactagtcggatggacggctaggaccttatacgtgtcgacggcggtggacngcgagcacgtcgcccgtctagtcgtccgttacggacgtcgggaacctaggtacctaccgtcgtaacgtcacgaccccg

SEQ ID NO: 403635 - DNA, 528 bp, Homo sapiens
  misc_feature: GZ8MTXP02GX076.13.11.A11.1.454.CMB.2.raw
  modified_base (346)..(346): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtcaactcagataaacgacaggctcgtggacgtccccagcccgcttctctggactccgaagntgatccgcacgcagggatagttactcatctctggctccagtctgacgatggagctgacttattacgttgtttgacttggacaacaacaacgcctggactcttacggacctgggaccacgggtcacccgtcaggtccacgcccgaacggcccaaacccgctacgtccacctctcgttcccccg

SEQ ID NO: 403636 - DNA, 547 bp, Homo sapiens
  misc_feature: GZ8MTXP02GZDBS.13.11.A11.1.454.CMB.2.raw
  modified_base (328)..(328): a, c, t, g, unknown or other
  modified_base (410)..(410): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaagccagggagtcctccccagttctcctgaggttcaggtcaaactcaagataaacgacaggctcgtggagtccccagccgcttcnctggactccaaggatgatccgacacgcaggatatactcatctctggctccagtctagacatgaggctagactattactgttntactggacacgaaacaacgcctggactcgtacggtacttcgggaacctacggttaccaacccgtcgtaaacgggtccaacgccccgaaaacggcccaaaacccccacgttacaccaaccttcccgtactttcccccc

SEQ ID NO: 403637 - DNA, 733 bp, Homo sapiens
  misc_feature: GZ8MTXP02IBO4O.13.11.A11.1.454.CMB.2.raw
  modified_base (250)..(250): a, c, t, g, unknown or other
  modified_base (257)..(257): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgacatatagttggtaccgacaggaanccgaggngtccctccctagttctcctgtaggttcaggtacaatcaagaataaacgacgagggctcgtggacgtccccagccgtcttcgtcgtggacctaccgaaaggtctacggtattcccgacctaacgccgaagggtacttagttacctcattcctcggtcgggccttccgtagtccgtagaacgtagttaggaacggccttagaactttacgttttaaccgttggttttacggtaccgtttacgggaccaaaccctaaaaccgtaacccggtccgttaggggtaacctttccggtttacccgggtacccggttaacccgggggtacctaaaccgggggtttcccctaacccgggtttaacccgtaacggggtacccacccggggtaacccccgaaacccggggtaaacccccaaacccccgtaaactttccgggtaaacccctaccccgtttacccggtttaccccggttaccccccccg

SEQ ID NO: 403638 - DNA, 583 bp, Homo sapiens
  misc_feature: GZ8MTXP02FVIE9.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtcctatgacatatattggtaccacagaagccgaggactccctcccctagttcctcctgtacggttcaggtacaaactcagaactaaacgacagggctcgtggacgtccccagccgtctctcgtggactaccgaaggatcgacttccggaccacgcaagggaattacttactacatctcgtcggaccttccagtctgacgatgacggctagtacttagttacgtgtttacgacgtttcggactaacaaacgtaacgtcctaggtaacttcgttacggacgtacgggaccacggtaccaccggtacgtaacgtccgacgaccccgaacgaaccctaaaccccgactcgtacctacctcgtccttaccccc

SEQ ID NO: 403639 - DNA, 611 bp, Homo sapiens
  misc_feature: GZ8MTXP02G4V7O.13.11.A11.1.454.CMB.2.raw
  modified_base (241)..(241): a, c, t, g, unknown or other
  modified_base (266)..(266): a, c, t, g, unknown or other
  modified_base (382)..(382): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatatggaccganagagccaggagtcctcccagtttcnctgagttcaggtcaaactcagaataaacgacgagggctcgtagggacgtccccgagccgtacttctctggactaccgaaggactgacttccgaccaacgcgaagggatacgttacnctaactctcgtaggcctacagtcctgacgatgaggctgtaacctagtttaacttggtttacgacgtttacgggacctaacgaaaccaacggtaccctgggtacttccgtttacggacccgttacggggaccctaccggtaccacccggttaccgtacggtaccaccggaccccgaaacggacccccaaaacccccgtacgtccgtacctaaccgttcctttaacccccg

SEQ ID NO: 403640 - DNA, 523 bp, Homo sapiens
  misc_feature: GZ8MTXP02GB74P.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgagttcaggtcaaactcagataaacgacaggctcgtggagtccccagccgctctctggactccaaggatgacttccgcacgcagggatatactcatctctggctccagtctgacgatgaggctagactattacgtgtttgacttggactaacaacgaacgctggactcgttacggacttgggacctacgggtcaaccggttcacggtcacgcccgaaggcccaaacccgctcgtcactctcgttaccccc

SEQ ID NO: 403641 - DNA, 698 bp, Homo sapiens
  misc_feature: GZ8MTXP02I2MV6.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttggtcctatgacatatatgtacgacagaagcaggagtcctccctacgttctcctgtaggttcgtaggtacaactaccaagaataaaacgaaccgaaaggacgtcgtacggtacggttaccccaacgcccggtccttccttacgttcgggaaccttacccgaaacggggaatacggtactttacccgggacccaaaccggtacccgaaacgggggtaaagttaacgtttaactttacccgaaagttacctacgtttacggggcgtttccccaaacgggtttacgtacgtaacgtagtaggtacggtacgtacgtaacgttaacgtttacgtttacggtttacgttacgttacggtaacgtaaaccgaaaccgtaaccgtacgtacgtacgtacgttaccgtacgtacggtaccgtaccgtaccgtaccgtacgtacgtacgaccgaccgaccgaaccgaacccactacgactacctactacctaccc

SEQ ID NO: 403642 - DNA, 583 bp, Homo sapiens
  misc_feature: GZ8MTXP02F921Z.13.11.A11.1.454.CMB.2.raw
  modified_base (215)..(215): a, c, t, g, unknown or other
  modified_base (292)..(292): a, c, t, g, unknown or other
  modified_base (342)..(342): a, c, t, g, unknown or other
  modified_base (386)..(386): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctcgtgggcgagagggccaccatcaactgacaagaccagccagagttgttttanacagctccgaacaataggaactacttagcttggtaaccaacagaaaccaggacagcctaccgaagttactctttacngggctcgtacccggatcccgggtcctgaccgattcgagtggcaggcggtntgggacagctttcactctcacatcagcagtccttgagctagaantggtgctaagttttatactgacagtactaattattatattcctcttaccctcgtcgggtacgttcggacccgaagggaccgtaggggtacgaaagtaccgaaaacgtaacgtgtacggtctacgaccgtaaaccctattccgtcgttaccttaaccgtaacttcccgttacccccgctaacgttcctaggttaaacg

SEQ ID NO: 403643 - DNA, 383 bp, Homo sapiens
  misc_feature: GZ8MTXP02JVA5Y.13.11.A11.1.454.CMB.2.raw
  modified_base (243)..(243): a, c, t, g, unknown or other
  modified_base (363)..(363): a, c, t, g, unknown or other
  modified_base (378)..(383): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccaatgacatcccagacaggttcagtggcaggtgggtctgggacagacttcactctcaccatcagcagactggaacctgaagactttgctactttatttcngtcaccagtatggtagtcacgtacactttggccagggaccaagctggagatcaagcgaactgtggctgcacatctgtcttccatccttcccgccatctgatagtacgtgactgagcgggntggcaggcgcatagnnnnnn

SEQ ID NO: 403644 - DNA, 640 bp, Homo sapiens
  misc_feature: GZ8MTXP02H3ZTN.13.11.A11.1.454.CMB.2.raw
  modified_base (359)..(359): a, c, t, g, unknown or other
  modified_base (396)..(396): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttgtcctatgacatatattggtaccgacagaagccgaggacgtccctcccctagtttcctcctggacggttcaggtacaaactcaagtaataaacgacgagggctcgtggacgtccccagccgctttcgcgtggactaccgaaggtntcgtacttcccgacacggcgaagggtacttattaccncattccgtcgtgggcctccgtagtctaggacgtagtggaggtctagtacttaatttcgttgtttacgtacgttggacctaacgaaaccgacgtccgttaggacttccggttaccggaccgttaccggggaaccctacggggtaccaacccgttccgtaacgggtaccaaccggaccccgaaaccggaaccccctaaacccccgaacgttcgtaccctaccctttcgttaaccccgtttcccccc

SEQ ID NO: 403645 - DNA, 675 bp, Homo sapiens
  misc_feature: GZ8MTXP02HBI8X.13.11.A11.1.454.CMB.2.raw
  modified_base (368)..(368): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaattgttggtccctatgacatatattggtaccacaggaacgccgagggacgtccctcccctagtttcctcctgacggttcaggtacaaactcaaagtataaacgacgagggctcgtggacctccccgagcccgtcttctcgtaggacctaccgaaggtntacgtacttcccggaccacggacgaagggtacttacttacctactacgtccgttcgtcggggtcccttacccgagttaccctgggaaccgtagttacgggacgggtacttacggtaaccttaagtttaccgtttaggtttacgtacgttacggactaaccgaaaaccgtacgtccgtaggtacttccgttaccggaccgtcgggtaacccgtacgggtacctcccggttacggacggtaccaccggtacccgaaaccggcccctaaacccgtacgtctaccgtacctccgttacccggtttcccccg

SEQ ID NO: 403646 - DNA, 390 bp, Homo sapiens
  misc_feature: GZ8MTXP02INJPZ.13.11.A11.1.454.CMB.2.raw
  modified_base (346)..(346): a, c, t, g, unknown or other
  modified_base (385)..(390): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaaacctgaaagtactttgactacttttattctgtcaccagtatggtaggtcacgtacactttggccagggaccaagctggagatcaaagcgaactgtgctgcaccatctgtctcactccttcccgcatctnatagtacgtgactggaggcgggctggcaaggcacatagnnnnnn

SEQ ID NO: 403647 - DNA, 386 bp, Homo sapiens
  misc_feature: GZ8MTXP02IGU4V.13.11.A11.1.454.CMB.2.raw
  modified_base (342)..(342): a, c, t, g, unknown or other
  modified_base (380)..(386): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactgaacctgaagtctttgctactttattctgtcaccagtatggtaggtcaccgtacacttttggccaggggtaccaagctggagatcaagcgaactggtggctgcacatctgtctcactcctccgcatctgntgtacgtgactggagcgggctggacaaggcgcaagtgnnnnnnn

SEQ ID NO: 403648 - DNA, 386 bp, Homo sapiens
  misc_feature: GZ8MTXP02JKN3D.13.11.A11.1.454.CMB.2.raw
  modified_base (357)..(357): a, c, t, g, unknown or other
  modified_base (381)..(386): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcaccagttggtgactcaacgtggacgttcggccagtgggaccaaggtggaaatgaaacgaactgtggctgcaccatctgtctcatcctcccgcatcctgatagtacgtgactgngcgggctgggcaaggcgacatagnnnnnn

SEQ ID NO: 403649 - DNA, 413 bp, Homo sapiens
  misc_feature: GZ8MTXP02HJTGV.13.11.A11.1.454.CMB.2.raw
  modified_base (404)..(404): a, c, t, g, unknown or other
  modified_base (406)..(413): a, c, t, g, unknown or other
tcagtcacgtactacacgaccggtgctcgatttagctacgactgcagggccagtcagattgtcagcagcaactacttagcctggtaccagcagaagcctggccacggcccccaggcctcctcatctacgatgtattcaggagaccactgacatccagacaggttcagtggcaggtgggtctgggacagacttcactctcaccatcagcagactaggaacctgaaagtacttgacttacttttattctgtcaccagtatggtacggtcaaccgtactactttggccgaaggggaccaaagctaggaagatacgaaagacgaaatggtggctgacaccatctgtctccatccctccgactatctagatagtaacgtgacgtgagcgggcaggaccgaaaggtcaanannnnnnnn

SEQ ID NO: 403650 - DNA, 566 bp, Homo sapiens
  misc_feature: GZ8MTXP02H75OM.13.11.A11.1.454.CMB.2.raw
  modified_base (182)..(182): a, c, t, g, unknown or other
  modified_base (368)..(368): a, c, t, g, unknown or other
  modified_base (376)..(376): a, c, t, g, unknown or other
  modified_base (408)..(408): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtntccccaggacagacagccagcatcacctgctctagaaataatggcagataaatatactctgtatcagcagaagtcaggccagtcccctgtgctggtcatctatcaagatgaccaagccggccctacgagggactccccccgtgacgtcgactttctctcggcctaccaactctacgggaactcgancccactcncgaccactacgacgccgggaccaggactaggngatggacgtcgtagtactagttacgtgtacgaggtcggtacgggacacggacgacgaccgtacgtccggtcccgtactacgttcgttaccgttacggaaccggtaccggaaccgtaccggtacccgtaccgtaccgtaacggtacccgaaccgacccg

SEQ ID NO: 403651 - DNA, 531 bp, Homo sapiens
  misc_feature: GZ8MTXP02JL5ZO.13.11.A11.1.454.CMB.2.raw
  modified_base (234)..(234): a, c, t, g, unknown or other
  modified_base (317)..(317): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgtctggaaataatgcagataaatntacttctggtatcagcagaagtcaggccagtcccctgtgctggtcatctatcaagatcgccaagcgccctcgagggactccgngagcgtacttcgtctggcctccaactcgtagggaactcgacgcctactctcgaccatacgaggcccgggacccagggctaagtggactggagtcctaggtacttagttacgtgtacgagggcgtagggacagcgagctacgtcgccccgatacgtcgttacgtacggacgtcgggaaccaacggtccaaccgtcaacgtcacgacccgaaaccg

SEQ ID NO: 403652 - DNA, 567 bp, Homo sapiens
  misc_feature: GZ8MTXP02HPJJ7.13.11.A11.1.454.CMB.2.raw
  modified_base (199)..(199): a, c, t, g, unknown or other
  modified_base (342)..(342): a, c, t, g, unknown or other
  modified_base (361)..(361): a, c, t, g, unknown or other
  modified_base (545)..(545): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcncagtggcaccaatgttggtcctatgacatatattggtaccgacagaagccgagggacgtccctccccagtttcctcctgacggttcaggtacaaactcaagaactaaacgacgaggctcgtggacgtccccagcccgctttcncgtaggacctaccgaaggntcgacttcccgacacgcgaggaattattacctcattccgtcgtaggcctacgagtctgacgtagtgacggctagaacttatttacgtgtttcgtacgttgactaacgaaacacgccgtggacttcgttacggactgggacctacgggtcaccgtcgtaacgcgacgaccaacggaaccccaacnctcgactacctctccgtacccc

SEQ ID NO: 403653 - DNA, 687 bp, Homo sapiens
  misc_feature: GZ8MTXP02HPD7S.13.11.A11.1.454.CMB.2.raw
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtggtggtacggccgtgggggtccctcagactctcctgtgcaacctctggattcagatttgatgagtatggcatacacgtcgggtcccgaccaaccgtccgaaggggaaggggctggcgtaggtgggtctcgtaggttaataaacgtggaagtggtgaccgtagactaaacctaacttcgtcgacgaagtaccttcgtaggtacgggaaacggggcccgtaattacccaaccctacttcccttacccgaaaggaacgaacgtaacggtcggaacccgaagtaaacccgttcccgtaaacacgtttacgcgtaaccgaaaagttacgaaacgtacggtacgtacgggacgtacggaacgggtaccgaacggttcccgtttaggtacctttttcggacggttacgggacggttaggttacgtaacggtacggtacgggttacgttaacggttaccgttacggtaacgtaacgg

SEQ ID NO: 403654 - DNA, 641 bp, Homo sapiens
  misc_feature: GZ8MTXP02JSFP5.13.11.A11.1.454.CMB.2.raw
  modified_base (243)..(243): a, c, t, g, unknown or other
  modified_base (270)..(270): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgacatatattggtaccanagaacgcgaggactcctcccagtttcnctgaggtcaggtacaactcaagaataaacgacgagggctcgtaggaccgtcccacgtccgtacttctcgtacggactaccgaaggtactcgacttccgaccgtaacgacgtaagggtaattacttacgtactaacttcgtcggtcgggtacctacccgtggtacgtaggaaccggtatacgggagtccgtagtaaaccttattttaacgttggtttacgtacgttagggaacccaaactaaaccgaccgtcgtacggtaacttccgttaccggaaccggttcggaacccgtcggtaccgtaccgtacgtacgggaccaacggtacccaacggaccccaacccgtacgtacgtacctaccgtcgtttccccg

SEQ ID NO: 403655 - DNA, 390 bp, Homo sapiens
  misc_feature: GZ8MTXP02HWUCQ.13.11.A11.1.454.CMB.2.raw
  modified_base (386)..(390): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactactttggccaggggaccaagctggagatcaagcgaactgtggctgcaccatctgtcttccatccttcccgcctatcctgatagtactgactgagcgggctggcaaggcgcatagnnnnn

SEQ ID NO: 403656 - DNA, 832 bp, Homo sapiens
  misc_feature: GZ8MTXP02F6H7X.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtcctatgacatatattggtaccgacagaagccgagggactccctcccctagtttcctccgtgtagttcaggtaccaaactcaagaataaacgacgagggctcgtggaccgtccccagtccgtcttctcgtacggacctaccgaaaggtactacgtacgttaccccgaccgtaccggccgaaagggggtaacttaacttacctacgtacttaccgttccgtcggggtcccttaccgtaacggttcgtacgggtaaccggtagttacggggtacggggtacttaacgggtaacctttttaaacgtttaaccgttttgggtttttacggtaacccgtttacgggaccctaaaacccgtaaaacccgtaacccggtaccggtttaacgggtaaccgtttcccggttacccgggggtaacccggtttaacccgggggaaccccgttaacccggggttaccgttaaacccccgggtttacccgggtttaaacggggtaccccgtaaacccgggtaaccccccggtaaaaccgggggaaccccccgtaaaaaccccccggttcccgttacggttacccccgtaaccccgtttaccccttttacccccggtttaaacccccccc

SEQ ID NO: 403657 - DNA, 678 bp, Homo sapiens
  misc_feature: GZ8MTXP02JT4JE.13.11.A11.1.454.CMB.2.raw
  modified_base (240)..(240): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcgtcctatgacatatattggaccanagaacgccgagggactccctccccgtagttcctccgtggaggttcaggtacaaactcaagtaactaaacgacgagggtctacgtcggaccgtccccagcccgtctttctcgtaggacctaccgaaggtatcgtacttcccgacctacggcgtaaggggtaacttacttactctaacttccgtcgtcgggtcccttacccgaagttcccgtagaccgtagtcggaacggtctacgtaactttagtttacgttgggtttacgacgttgggacctaaaccgaaaccgaacggtcccgttaggtaacttcccggtttaccgggaaaccgtcggggtaaacccgtaccggttcccgtaacccggttccgtaacgggtacccaaccggaccccgaaacggccccaaaccccgtacgtccgtacctaccttcctccgttaccccc

SEQ ID NO: 403658 - DNA, 341 bp, Homo sapiens
  misc_feature: GZ8MTXP02I63JK.13.11.A11.1.454.CMB.2.raw
  modified_base (242)..(242): a, c, t, g, unknown or other
  modified_base (304)..(304): a, c, t, g, unknown or other
  modified_base (314)..(314): a, c, t, g, unknown or other
  modified_base (331)..(341): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagactttgctactttattcngtcactagtatgtaactgtgctgcaccatctgtcttcattcctcccgctatctgatagtctnactgagcggntggacaaggcacatagnnnnnnnnnnn

SEQ ID NO: 403659 - DNA, 559 bp, Homo sapiens
  misc_feature: GZ8MTXP02ITNEX.13.11.A11.1.454.CMB.2.raw
  modified_base (236)..(236): a, c, t, g, unknown or other
  modified_base (341)..(341): a, c, t, g, unknown or other
  modified_base (472)..(472): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctctatgagctgactcagccaccctcagtgtccgtgtccccaggacagacagccagcatcacctgctcagaaataattggacagataaatntacttctgtatcagcagaagtcaggccagtcccctgtgctggtcatctatacaagatcgaccaagccggccctacgacgggtactcccccgtagacgcgtattcncgttcggcctaccgaaactccgtacggaacctcgacgtccaactcctacgaccatcgacgacccgggacccaggtcctaagtggagtggaaggtctagtacttattacgtagtacgagggtcggaggaacnggacagccgacgtccgcccgattagtccgttacgtaccggacgtacggaaccgacggtaccaccgtacgtaacggtccacgaacccg

SEQ ID NO: 403660 - DNA, 546 bp, Homo sapiens
  misc_feature: GZ8MTXP02IANHL.13.11.A11.1.454.CMB.2.raw
  modified_base (287)..(287): a, c, t, g, unknown or other
  modified_base (320)..(320): a, c, t, g, unknown or other
  modified_base (366)..(366): a, c, t, g, unknown or other
  modified_base (390)..(390): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttaggtaccaacagaaaccaggacagcctcgaagttactctttacgngggctctacccgggaatccgggtccctgaccgnttcgagtggcaggcgggtctgggacagtactttcactctcacatcngcagccttcaggctagaacgatgnggctagtttatactgtcagcaattattatatctctcctctcggtacgttcgaccgaagggaccgagggtaggaaactacgaaaacgaacttggacggtctcgaccacctagtcttcgtccttaacacttcccttacccgcctattcgtacgtaacg

SEQ ID NO: 403661 - DNA, 581 bp, Homo sapiens
  misc_feature: GZ8MTXP02HTJ84.13.11.A11.1.454.CMB.2.raw
  modified_base (222)..(222): a, c, t, g, unknown or other
  modified_base (246)..(246): a, c, t, g, unknown or other
  modified_base (258)..(258): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaacaatgttgcctatganatatattggacacagaagccaggntcctccagttcnctgagtcagtacaaatcaagataaacgacaggctcgtaggacgtccccagccgctttccgtgagacctacgaagtatgtactccgaacacgcgtaaaggtactattaccgactaactccgtcgtcggaccttccgagtctacgaacgagtaggaagtactagtaactttaagttaacgtttgtttacgtacgtacgaaccaaactaaaccgaacgttcgtagtacgttacgttacgtaccggtacggaccgtaccgtaccgaccgtacgtacgtacgacgaaccgaaccgaaccgaacccactactactacctcctacctccc

SEQ ID NO: 403662 - DNA, 388 bp, Homo sapiens
  misc_feature: GZ8MTXP02JDFUQ.13.11.A11.1.454.CMB.2.raw
  modified_base (342)..(342): a, c, t, g, unknown or other
  modified_base (380)..(388): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttattctgtcaccagtatggaggtcaccgtacacttttggccaggggaccaagctggagatcaagcgaactgtggctgcaccatctgtctccatctcccgcatctgntagtacgtgacctgagcgggctggcaaaggcgcatagnnnnnnnnn

SEQ ID NO: 403663 - DNA, 560 bp, Homo sapiens
  misc_feature: GZ8MTXP02JPEJ1.13.11.A11.1.454.CMB.2.raw
  modified_base (220)..(220): a, c, t, g, unknown or other
  modified_base (366)..(366): a, c, t, g, unknown or other
tcagtcacgtactacacgaccggtgctcgatttagctacgactgcagggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagcctacatcacctgctctgganatgtattgactaagagtatggttcctggtatcagcagaaggcaggccagccccctgtcctactcatctttacaaataccaggccggccctcgtcggggtccctgacgcgtactcctccccggcctcccgcctcgtcgggaaccacncgtccactctcgccatcgacgccgggaccagcctatgatgagctgtctacttctagtcgaggcgtgggacacgacgcgtgcgtggtcgggacgggacgggaccaggttcgcggtaccggtcgttacgggtccacggccccaaggccgtccggcccccgttcggtcctaccgtccgttccgttccccctaccccg

SEQ ID NO: 403664 - DNA, 669 bp, Homo sapiens
  misc_feature: GZ8MTXP02IGA9S.13.11.A11.1.454.CMB.2.raw
  modified_base (241)..(241): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttcgtcctatgactatatattggtaccganaagaagccgaggactccctaccctagttcctccgtggtacggttcgaggtacaaactcaagtaactaaacgacgaggctcgtacggaccgtccccgagcccgtcttctcgtggacctaccgaaggtctagacttcccgacacgacgaggtattacttactcacttctacgtgggacccttcgagttctaggacgtagttaggaacggtctagaacctttaaagtttacgtttaggttttcgtaacgtttcgggaaccaaaccgtaaacgtaaaccggtccgttaagggtactttacccggtttaccggaccggttacgggacccgtaccggttacccgacccgttccgtacggtacccgaaccgtacccggaaaaccggccccaaacccgtacgttcggacctaccgttcccgttaccgttccccccg

SEQ ID NO: 403665 - DNA, 694 bp, Homo sapiens
  misc_feature: GZ8MTXP02I6T1G.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctactgcgcagtcggaccaacctattggttcgtacctagtgaactattattagttacggtaccacgaaggaacgccggaagggtaccgtcccctacccgttagtttcctccgtaggtacggttcgacggtaacctaactcgaagtaaacgtaaaccggacgtacgggtccttcggtacgggaccccgttaccccaggtcccttccgtttccgtcggtacggtaccctaaccggaaaggtctacggttaccttaccccggaaccacggccggtaaagggtactttaacgttaccactacttcgtcggtcggtaccctacgtacgttcgttacgaacgtagtacggacgtcgtacgtactttaacgtttacgtttggttaacgtcggttacgaaccgtaacaaaaccgtccgtcgtacgtacttccggtacgacgtacgggaacctcggtaccaccgtcgtacgcaccgaccaacggccctaccagtctacactcgtacccgtccc

SEQ ID NO: 403666 - DNA, 581 bp, Homo sapiens
  misc_feature: GZ8MTXP02FS36A.13.11.A11.1.454.CMB.2.raw
  modified_base (305)..(305): a, c, t, g, unknown or other
  modified_base (380)..(380): a, c, t, g, unknown or other
  modified_base (462)..(462): a, c, t, g, unknown or other
  modified_base (530)..(530): a, c, t, g, unknown or other
  modified_base (546)..(546): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtgtggtacggccgtgggggtccctcagactctcctgtgcaacctctggattcagtatttgatgagtatggcatacacgtcgggtcccnccaacctccgaggggaagggctggcaggtgggtctcgtaggtataaacgtggaagtggtgcagcaactaactttngacagacctcgtggtagggaacggggtcctattcccaacctagtcctaccgagacgactagtcgaccgaagaacctccgaangtctgaaactaaatcggaaactggtccgtacgggagtcggaggaccgtcggtctttagttactttcgngtcggacgtaggttancgtaggtcgtcgtacggttacctacggactaaggg

SEQ ID NO: 403667 - DNA, 583 bp, Homo sapiens
  misc_feature: GZ8MTXP02IEEIW.13.11.A11.1.454.CMB.2.raw
  modified_base (269)..(269): a, c, t, g, unknown or other
  modified_base (358)..(358): a, c, t, g, unknown or other
  modified_base (559)..(559): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctcttttgcttctcctggagcgtcagccagtctcacctgcaccttgcgcagtgcacatgttgcctatgacatatattggaccgacagaagccgagggacgtccctccctagtttccncctgacggttcaggtacaaaactcaagataaacgacgagggtctcgtaggactcccccagccgtcttcctcgtggactccccgaaaggntcgacttccgacaacgcgaggatacttactcatctcgtgctccagtctagacgagtgagtctagacttagttaacttggttttacgacgtttaggacctaaccgtaacaaccggtccgttaggtacttccgttacggaaccgtcgggaccctacggtcctaccggtcttaaacggctacgacccgaagaccccaaacccgntcgtccactccgtctacccctccc

SEQ ID NO: 403668 - DNA, 537 bp, Homo sapiens
  misc_feature: GZ8MTXP02I2M2N.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatatggtaccgacagaagccagggagtcctccccagtttctcctgagttcaggtacaactcagataaacgacagggctctggacgtccccagcccgcttctctggactaccaaggatgacttcccgaccacgcaagggatattactcatctcgtgggctccgagtctgacgagtgaggctgacttattacttgtttgacgttggactaacaacaacgtccaggcttcgtcggactcgggaccacggtaccaccgtcgacggtccacgcccgaaggcccaacccacgtcgacctactcttcgtaccccc

SEQ ID NO: 403669 - DNA, 586 bp, Homo sapiens
  misc_feature: GZ8MTXP02GRN8U.13.11.A11.1.454.CMB.2.raw
  modified_base (379)..(379): a, c, t, g, unknown or other
  modified_base (385)..(385): a, c, t, g, unknown or other
  modified_base (396)..(396): a, c, t, g, unknown or other
  modified_base (401)..(402): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttcctcctgaggttcaggtacaaactcaagataaacgacaggctcgtggacgtccccagcccgtcttctcgtgactccgaaggatgacttccgacacgcagggatatctnatctcnggctcgagtcngacgnngagctagacttattcgtgtttgattcggactaacgaaacgtacgtccgtagacttccgttacggaccgtacggggacctacgggtcctacccggttaccgtaacggtccaaccggaccccgaaaccggaacccctaaaaccccgtcgtacggtacctaccgttccgtttacccgtttacccccc

SEQ ID NO: 403670 - DNA, 614 bp, Homo sapiens
  misc_feature: GZ8MTXP02JOGY9.13.11.A11.1.454.CMB.2.raw
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgcccagtgtgaggtgcagctggtggagtctggaggaggcttgatccagccgtggggggtccctgagactctcctgtgcagcctctggtcaccgtcagtcacacctacatgagctgggtcccgccgaggctccgaggggaaggggctggagtgcgttctcttttattagtagtagtgtatacattactccgcagacctccgtggacggggccgtattccacctatcctaccgaagacgtacaactttaccaaaaggaaccaccgtactttagttttacctaccgtaaaatcgaaacaacgtccctagacggacgtccgaagtacggacaaccgggtcccgttaggttacttaaaccgtggtagccggtaaggaagtacggtcgggggaacccctaacggaaaacgttttaccgacggtccttaaagtgggtaacccg

SEQ ID NO: 403671 - DNA, 543 bp, Homo sapiens
  misc_feature: GZ8MTXP02FFWIX.13.11.A11.1.454.CMB.2.raw
  modified_base (352)..(352): a, c, t, g, unknown or other
  modified_base (376)..(376): a, c, t, g, unknown or other
  modified_base (383)..(383): a, c, t, g, unknown or other
  modified_base (521)..(521): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttcctcctgaggttcaggtacaaactcagataaacgacaggctcgtggacgtccccagcccgtcttctcgtggacctccaaggntgatcccgcacgcgaggatatacnatctcgnggctcagtctagacgatgaggctagacttattactggtttgacgttggacaacaaaccgaacgccgtaggactccgttcggaccgtcgggaccacgggtccacccgtcgtacggtccacgcccaaggccccaaacccnctcgccactctccgttaccccc

SEQ ID NO: 403672 - DNA, 380 bp, Homo sapiens
  misc_feature: GZ8MTXP02F29T6.13.11.A11.1.454.CMB.2.raw
  modified_base (244)..(244): a, c, t, g, unknown or other
  modified_base (341)..(342): a, c, t, g, unknown or other
  modified_base (375)..(375): a, c, t, g, unknown or other
  modified_base (379)..(380): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagactttgctacttttatttcngtcaccagtatggtagtcacgtacactttggccagggaccaagctggagatcaagcgaaactgtggctgcaccatctgtctccatcttccgcatctnntagtacgtgactgagcgggctggcaaaggcganatgnn

SEQ ID NO: 403673 - DNA, 587 bp, Homo sapiens
  misc_feature: GZ8MTXP02GT87W.13.11.A11.1.454.CMB.2.raw
  modified_base (344)..(344): a, c, t, g, unknown or other
  modified_base (368)..(368): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgagttcaggtcaaactcagataaacgacaggctcgtggacgtccccagccgcttctctggactccaaggntgacttccgcacgcaggatatacncatctctggctcagtctgacgatgaggctgacttattactgttgacttggactaacgaacaaccgtccgtaggtaacttcgttaccgggaccgttacggggaaccctaacggggttccaacccggttacccgtacggggtacccacggacccccgaaaacgggccccctaaaacccccgacgttacgtacctaaccgttttccggttacccctacccgg

SEQ ID NO: 403674 - DNA, 621 bp, Homo sapiens
  misc_feature: GZ8MTXP02H0Q6S.13.11.A11.1.454.CMB.2.raw
  modified_base (390)..(390): a, c, t, g, unknown or other
  modified_base (471)..(471): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcttgggttttccttgttgcttattttaaaaggtgtccagtgtgaggtgcagctggtagagtcgtgggggaggtgtggtacggccgtgggggtccctcagactctcctgtgcaacctctggattcagtatttgatgagtatggcatacgacgtgggtcccaccaaccgtccgaggggaacggggctggcgtaggtgggtctcgtaggtaataaacgtggaactgggtcgccagcaactaacttntgacagtactcgtgaggaacgtcctattcacctattcccgaccgagacgacgaggtacgaccgagtaaacctcccgtaaanacgttcacgaacaaagtacgaacgagttccgtacgggacggttacggaacggtaaccctacgggttccttttagggttacttttcgtagttcggacggttaacggttagaaccgtgggtgtaccgttacggttaactttacgactaaggg

SEQ ID NO: 403675 - DNA, 591 bp, Homo sapiens
  misc_feature: GZ8MTXP02JKKVI.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctcccctagtttcctccctgaggttcaggtccaaactcagaataaacgacaggctctggacgtccccagccgcttctctggacctccgaaggatcgacttccgaccacgcgagggtatattactcatctcgtgggaccttcccgagtctggacgtagtggacgggtctacgtaactttaatttacgtttggtttacgtacgtttgggacctaacgaaacctaacgcctagggtacttccgttacgggacctggggaccctacggtccaacccggtcgtacggtcacgacccgacgaaccccaacccgattccgctactccgttcgtcccccg

SEQ ID NO: 403676 - DNA, 609 bp, Homo sapiens
  misc_feature: GZ8MTXP02FUQ6J.13.11.A11.1.454.CMB.2.raw
  modified_base (271)..(271): a, c, t, g, unknown or other
  modified_base (407)..(407): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagcagggacgtccctccccagttcncctgaggttcaggtcaaactcagaataaacgacgaggctcgtggacgtcccccagccgtcttctcgtggacctaccgaagatgtacttcccgacacgcagggatacttactcattctcgtggcctcagtcagacgntgagctagacttattacgtgtttagtacgttggacctaacgaaacgaaccgtccgtaggtaacttcccgttacgggtaccgtacggggtaacccacgggtaccgtacccggttccgtaacggtacccaacggaccccgaaaccgggaaccccctaaaccccaacgtccgtacctaaccgttcccgttccggtttaacccccc

SEQ ID NO: 403677 - DNA, 684 bp, Homo sapiens
  misc_feature: GZ8MTXP02IHXPZ.13.11.A11.1.454.CMB.2.raw
  modified_base (241)..(241): a, c, t, g, unknown or other
  modified_base (397)..(397): a, c, t, g, unknown or other
  modified_base (438)..(438): a, c, t, g, unknown or other
  modified_base (456)..(456): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgtctattttaaaaggtgtccagtgtgaggtgcagctggtagagtcgtggggaggtgtggtacggccgtgggggtcctnagactctcctgtgcaacctctggattcagtatttgatgagtatggacatacacgtcgggtcccgaccaacccgtccgaaggggaacgggctggctaggtgggtctacgtaggtaactaaacgtggaatggtcgaccagacaaactaactttgtcgnaacgtaccttcgtggtaggaaacgggccctataccaacctntccctacgaagacgaacnggtacgaccgaagaaacccttccgtaaacacttcgaagactaaaatcgaaacgtacgttccggtacgggaagtaccgggaaacggacccgtaacccgggttctttacgggtttacttttacccggtagggtttacggaaccgggtttaagggtttaacgaacggtaaacgggttttcggggaccgtttacgggtttaaaacccgtttacgggaacctttaaaaggggg

SEQ ID NO: 403678 - DNA, 702 bp, Homo sapiens
  misc_feature: GZ8MTXP02JJGYP.13.11.A11.1.454.CMB.2.raw
  modified_base (351)..(351): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagttcctcctgaggttcaggtcaaactcagaataaacgacaggctcgtggacgtccccagccgcttctcgtggactccgaaaggntcgactcccgaccacgcgaagggtactattactactatccgtcgtgggtcccttaccgaggttcctaggaacgtagtcggaagggtctacggtactttaactttacgttggttttacgacgtttacgggaccctaaacgaaaccgtaaaccggtcccgttaggggactttacccggttaccggggtaacccgttacgggggaaacccctaccgggggttaccctaaaccccggggttcccttaaacgggggtaccccaaccgggacccccgaaaacggggaaccccccaaaacccccgtacgtttaccggtaccctaaacccgtttccctttacccggtttaacccccccc

SEQ ID NO: 403679 - DNA, 345 bp, Homo sapiens
  misc_feature: GZ8MTXP02JS5CC.13.11.A11.1.454.CMB.2.raw
  modified_base (314)..(314): a, c, t, g, unknown or other
  modified_base (334)..(345): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaatactttgctacttttattctgtcacagtatggaactgtgctgcaccatctgtctcatcctccgctatctgaatgtacgtgactgagcgggntcggacaagggcacagtagnnnnnnnnnnnn

SEQ ID NO: 403680 - DNA, 334 bp, Homo sapiens
  misc_feature: GZ8MTXP02FLTMT.13.11.A11.1.454.CMB.2.raw
  modified_base (325)..(325): a, c, t, g, unknown or other
  modified_base (331)..(334): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggaactgtggctgcacatctgtcttcatcttcccgcatctgatagtacgtgactgagcggctcggcaaggcncatagnnnn

SEQ ID NO: 403681 - DNA, 541 bp, Homo sapiens
  misc_feature: GZ8MTXP02G66WL.13.11.A11.1.454.CMB.2.raw
  modified_base (239)..(239): a, c, t, g, unknown or other
  modified_base (277)..(277): a, c, t, g, unknown or other
  modified_base (290)..(290): a, c, t, g, unknown or other
  modified_base (295)..(295): a, c, t, g, unknown or other
  modified_base (416)..(416): a, c, t, g, unknown or other
  modified_base (433)..(433): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatntaacttctggtatcagcagaagtcagccagtcccctgngctggtcatctancaagntcgaccaagccgcccctagacggggtactccccccgtagacgcgtactttccgtcgtggccttacccgaaacttcgtacgggaacctcgacgtcccactctacgacatcgacgcggacccnggactagcgatgcggtntagtactattacgagtcgagggtcgtaggacagcagcacgccgccgtctacgtcgtcgtacggacgcgggaacgtacggtccaccgtaccgtacgtccgaacgacccg

SEQ ID NO: 403682 - DNA, 513 bp, Homo sapiens
  misc_feature: GZ8MTXP02GGA98.13.11.A11.1.454.CMB.2.raw
  modified_base (248)..(248): a, c, t, g, unknown or other
  modified_base (282)..(282): a, c, t, g, unknown or other
  modified_base (354)..(354): a, c, t, g, unknown or other
  modified_base (372)..(372): a, c, t, g, unknown or other
  modified_base (376)..(376): a, c, t, g, unknown or other
  modified_base (413)..(413): a, c, t, g, unknown or other
  modified_base (484)..(484): a, c, t, g, unknown or other
  modified_base (501)..(501): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgtttatacagctccgacaatagaactactagcttggtaccaanagaaaccaggacagcctcgaagttactctttacnggctctacccggaatcccgggtcctgaccgattcagtgcagcggtctgggacagactttcactctcacatcngcagccttcagctgaaanatgnggctagtttattactagtcagactaatatatatcctntacctcgtcgacgttcgaccaaggaccgagggagtaaagacaaacgaactgtacgctacgacaccactctntctctactccttccccnctactctatacg

SEQ ID NO: 403683 - DNA, 384 bp, Homo sapiens
  misc_feature: GZ8MTXP02F0HK0.13.11.A11.1.454.CMB.2.raw
  modified_base (248)..(248): a, c, t, g, unknown or other
  modified_base (342)..(342): a, c, t, g, unknown or other
  modified_base (374)..(374): a, c, t, g, unknown or other
  modified_base (379)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagctttgctactttattctgtcaccngtatggtagtcaccgtacacttttggccaggggaccaagctggagatcaagcgaactgtggctgcaccatctgtctcactcctccgcatcctgntagtacgtgactgagcgggctggcaaggcganagtgnnnnnn

SEQ ID NO: 403684 - DNA, 595 bp, Homo sapiens
  misc_feature: GZ8MTXP02J1RFY.13.11.A11.1.454.CMB.2.raw
  modified_base (285)..(285): a, c, t, g, unknown or other
  modified_base (290)..(290): a, c, t, g, unknown or other
  modified_base (386)..(386): a, c, t, g, unknown or other
  modified_base (509)..(509): a, c, t, g, unknown or other
  modified_base (545)..(545): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtgtggtacggccgtgggggtccctcagactctctgtgcacctctggattcagtattgatgagtatggnatacncgtcgggtcccaccaaccgtccgaggggaagggctgcgaggtggtctcgtaggtaataaacgtggaagtgggtcgcccgagaccaactaacttagngacacgtactcgtgtacggaacgggcctattccaccagtcctacgagacgactacggtacgaccgaacgaacccgtccgtaactactcgtacgaacgtaaaatcgaaacgtacgtcgtacggnggtaccgaagaccgtacggtcctttggtactttcgngtcgtacggtaggttacgcgtacggtgcgttaggtacctacgacgtaagg

SEQ ID NO: 403685 - DNA, 678 bp, Homo sapiens
  misc_feature: GZ8MTXP02GMQ8Z.13.11.A11.1.454.CMB.2.raw
  modified_base (221)..(221): a, c, t, g, unknown or other
  modified_base (235)..(235): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgttcgtcctangacatatatgacanagaagcgaggactcctcccgtagtttcctcctggagttcaggtacaaactcaagaactaaacgacgagggctacgtggaccgtccccgagcccgtcttctcgtggacctaccgaaaggtctcggtaccgcccgaacgcgaggaagtaacttactaccatacttccgtacgggtccgtacctaacgtcgttacgaacggtaacgtggtaacgggtccgtagttaaaccttaagttttaacgtttcgttttacggttacgttacggtaccaaacgaaaccaaaccggtccgtagttaacgtccgtttaccggacccgggtacggtacccggtaccggtacccgttacccggtacccgttaccggtaaccgacccgtaaccccgaaccggaccccgaaacccccgtacgttccgtacacccttccttcccgttaccccctaccccc

SEQ ID NO: 403686 - DNA, 591 bp, Homo sapiens
  misc_feature: GZ8MTXP02HWAUC.13.11.A11.1.454.CMB.2.raw
  modified_base (357)..(357): a, c, t, g, unknown or other
  modified_base (420)..(420): a, c, t, g, unknown or other
  modified_base (443)..(443): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccacagaagccgagggactccctccccagtttcctcctgtaggttcaggtacaaactcagaataaacgacgaggctcgtggactccccgagcccgtcttctcgtggacctaccgaaggtntcgtacttcccgacacgcgaagggtacttacttactcattctcgtggcctccgagtctgacgntgagctagacttattactgtttnacgttgacaactaacgaaccgcgttagacttccgttacggaccgtcggggaccctaacggtccacccgttccgtacggtaccaccgacccgaaacggaaccccctaaacccgactcggaccctaccgtccgtttacccggtccccccg

SEQ ID NO: 403687 - DNA, 628 bp, Homo sapiens
  misc_feature: GZ8MTXP02FWPRV.13.11.A11.1.454.CMB.2.raw
  modified_base (337)..(337): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcgtccctatgacatatattggtaccgacagaagccagggacgtccctcccctagtttcctcctggaggttcaggttcaaactcagataaacgacaggctcgtggacgtccccagccgtcttntcgtggactaccgaaggactgtacttcccgaccacgcgaaggggtattacttacctcattctcgtgggtcctacagttctgacgataggaggctagacttagttacgtgtttacgacgttggaccaacgaaaccgacggtccgtacgggaacttccggttcgggacccgttacgggggtaacccacccggttaccgaaacccggttccgtacgggttaccgaaccggacccaaaccgggaacccaaaaccccctacgtcggtacctaaccttaccttcggtttaacccccc

SEQ ID NO: 403688 - DNA, 598 bp, Homo sapiens
  misc_feature: GZ8MTXP02JC211.13.11.A11.1.454.CMB.2.raw
  modified_base (334)..(334): a, c, t, g, unknown or other
  modified_base (349)..(349): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttcctcctgaggttcaggtcaaactcagataaacgacaggctcgtggacgtcccagcccgcttcncgtggactccaaggntgtacttccgacctacgcgagggtatattactcatctcgtcggctcagtctgacgtatgacggctagtacttacttacgttgtttagacgttggacctaacaaacgaccgtcctagggacttccgttaccggaccgtcggggacccaccgggttccacccggttacgtacggtccaaccggtaccccgaaacgggtccccaaacccccgtacgtccggtccctaaccgtcccgttaccgttaccccccg

SEQ ID NO: 403689 - DNA, 379 bp, Homo sapiens
  misc_feature: GZ8MTXP02GXYT6.13.11.A11.1.454.CMB.2.raw
  modified_base (340)..(340): a, c, t, g, unknown or other
  modified_base (369)..(369): a, c, t, g, unknown or other
  modified_base (375)..(379): a, c, t, g, unknown or other
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtgctgcacatctgtcttcatctcccgcatcctgntagtacgtgactgagtcggctgcaaggcncatagnnnnn

SEQ ID NO: 403690 - DNA, 705 bp, Homo sapiens
  misc_feature: GZ8MTXP02I7ICY.13.11.A11.1.454.CMB.2.raw
  modified_base (194)..(194): a, c, t, g, unknown or other
  modified_base (223)..(223): a, c, t, g, unknown or other
  modified_base (238)..(238): a, c, t, g, unknown or other
  modified_base (251)..(254): a, c, t, g, unknown or other
  modified_base (478)..(478): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagcccaccctccatcgtccgtcgtccccccgganagacagcctacatccacctgcctctgganatgtatgactaacgngtatgtctggtannnnagaggcaggccacgccccctgtcctactctatctttacaaactaccgaggccggccctcggtcggggtccctggacgtcgtacttccgtcccccgggcctcccggtcccttacggtacggggaaacccacgtacgtcctaacctccgttacgaccctacgtcccgaacgggtccccgggggtaaccccaaaggtacccctttgggggaaactttgggtaacggngtacggttccgttacgtttccgttaccgtttaccgttacgggtccggtacggggtaccggtacgggacgtaaccggtacggtccggttacgggtccggtcggggtaccggggtaccgggtacgggtaccgtacgggtacccgtacggtaccggtacgtacggtaccgacggtcccgaccggtcccgtccggtaccccgtccgtccgtcccgtccctacccgtccccg

SEQ ID NO: 403691 - DNA, 389 bp, Homo sapiens
  misc_feature: GZ8MTXP02JG6FV.13.11.A11.1.454.CMB.2.raw
  modified_base (349)..(350): a, c, t, g, unknown or other
  modified_base (385)..(389): a, c, t, g, unknown or other
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcagtgggtctgggacagacttcactctcaccatcagcagactggaacctgaagtactttgctactttattctgtcaccagtatggtaggtcaccgtactacgttttggaccgtagggaccaagctggagatcaagcgaactgtgctgcaccatctgtctccatcctcccgctatctnntagtacgtgactgagcgggctgcaaggcgcatagnnnnn

SEQ ID NO: 403692 - DNA, 534 bp, Homo sapiens
  misc_feature: GZ8MTXP02FTWZ8.13.11.A11.1.454.CMB.2.raw
  modified_base (342)..(342): a, c, t, g, unknown or other
  modified_base (369)..(369): a, c, t, g, unknown or other
  modified_base (387)..(387): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacaggctctggagtccccagccgcttctctggactccaaggntgacttccgacacgcagggatattacncatctctgggctcagtcngacgatgaggctgactattactgtttgacttggacacaacaacgcctaggactcgttacggaccttgggacccgtacggtcctacccgtcctaacggtccgacgcccaaacggccccaacccgactcgtccactctccgttaccccc

SEQ ID NO: 403693 - DNA, 544 bp, Homo sapiens
  misc_feature: GZ8MTXP02H590D.13.11.A11.1.454.CMB.2.raw
  modified_base (351)..(351): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgaggagtccctccccagtttcctcctgaggttcaggtacaaactcaagaataaacgacaggctcgtggacgtccccagccgcttctctggactaccgaaggntaggacttccgaccacgcgagggtactattacctcatctcgtggctcgagtctgacgatgaggctgactattactgtttgtacttggacaaaacacgctaggatcgtcggactgggaccacggtcaccgtctacggtcacgacccgaacgacccaaacccgtactcgtactacgttcctcggttccccgtccc

SEQ ID NO: 403694 - DNA, 727 bp, Homo sapiens
  misc_feature: GZ8MTXP02JJXMN.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtctccctctctgcttctcctggagcgtcagccagtctccacctgcaccttgcgcagtgcaccaatgttcgtcctatgactatatagttcggtaccgacaagaacgccgaaggggtactccctcccctagttcctccgtggaggttcaggtacaaactcagtaacgtaaacgacgtagggctcgtcggaccgtccccgagcccgtcttctcgtaggaccctaccgaaagggctagtaccttacccggacccgaacggtacgaggggtaacttaacgttaccgtacctacttccgttacccggtcgggtaccctacccgtggttaccgtacggtaacggtagtcgggtaacggtcgttacgtaaacctttagtttaccgtttggttttacgtaccgtttcggaacctaaaccgaaaccgtaaccggtaccgttagggtactttacccggttaccgggaccgttaccgggggaacccgtaccgggtcccaacccgggttacgtaacgggtccaaccggacccccgaaacggtaacccccaaccccgtacgtccgtacctaccctttcccgttaccttacccccc

SEQ ID NO: 403695 - DNA, 384 bp, Homo sapiens
  misc_feature: GZ8MTXP02FF3HL.13.11.A11.1.454.CMB.2.raw
  modified_base (341)..(341): a, c, t, g, unknown or other
  modified_base (379)..(384): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtagcaccgtacactttggccaggggaccaagctggagatcaagcgaactgtggctgcaccatctgtcttccatctcccgccatctgntagtacgtgactgagcgggctgggcaaaggcgcatagnnnnnn

SEQ ID NO: 403696 - DNA, 643 bp, Homo sapiens
  misc_feature: GZ8MTXP02JHGZ4.13.11.A11.1.454.CMB.2.raw
  modified_base (304)..(304): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggactcctcccctagttctcctgaggttcaggtacaactcagaataaacganaggctcgtggacgtccccagccgtcttctctggacctaccgaaggtatcgacttccggacctacggcgaagggtactacttacgtactactccgtcgtcgggtcctccgagttctagacgagttaggaacggtctacggtaactttagtttaacgttggttttacggaacctttcgggaccaaacctaaaccgtaacccggtccgtgggtaacttcccggtttaccggacccggtacggggtaccctacgggtccctaaacccggtccgtacgggtaccaccggaccccgtaacggaacccctaaccctacgtcgtacctacgtccgtcctttaccccc

SEQ ID NO: 403697 - DNA, 627 bp, Homo sapiens
  misc_feature: GZ8MTXP02I4LE5.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtacaaactcagataaacgacgaggctcgtggacgtccccagccgcttctctggactccaagatgattccgacacgcagggatatactcatctctggcctcagtctgacgatgacggctagacttatttacttgtttcgacgtttcgggacaaaccgaaaccgaaccgtcccgtaggggaacttccggtttacgggacccgttacggggtaacccgtacgggttaccctaccccggttaccgttaacggggttcccaaccggtacccccgaaaaccgggtaacccccgaaaaccccctaacgttcggtaccctaaccttcccgttaccggtttaacccccccg

SEQ ID NO: 403698 - DNA, 596 bp, Homo sapiens
  misc_feature: GZ8MTXP02FI9OD.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtcaaactcagataaacgacagggctctggacgtccccagccgtcttctctggactccgaaggatgacttccgcacgcagggattagttactcatctcgtgggctccagtctgacgatgaggctagacttattactgtttgactttggactacaaaccgaacggccctagggtactccgtttacgggacccgttggggaacccctacgggtacccacccggttccgtacgggttcccgaacgacccccgaaacgggaacccccaaaccccgtacgttccggtacctaaccctccgttaccgtttaacccccc

SEQ ID NO: 403699 - DNA, 718 bp, Homo sapiens
  misc_feature: GZ8MTXP02JTHBE.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagtttcctcctggaggttcgaggtacaaactcgaagaactaaacgacgaggctcgtggacgtccccgagccgtcttcctctggacctccaaggatcgacttccgacacggcaaggggtatacgttactctactcgtcgtcgggcctccgtacgtcgtacgagtagtggacggtcgtagtaacctttaagtttaccgttagggtttttacgacgtttacggggtacctaaaacccgttaaaaccgaaccggtacccggttagggtaaaccgtttccggttaacccggggaaccggtttccgggggaaaccccggtaccgggttaccgacccccgggttaccgtaaacggggttacccaacccgggaacccccgaaacggggaaccccctaaacccccggttaaccgttccgggtaacccctaaccggtttacccttcccggtttaacccccccc

SEQ ID NO: 403700 - DNA, 639 bp, Homo sapiens
  misc_feature: GZ8MTXP02JCMH8.13.11.A11.1.454.CMB.2.raw
  modified_base (240)..(240): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctacaccttgcgcagtggcaccaatgttgtcctatgacatatattggtaccanagagccagggatcctcccagttctcctgacggttcaggtacaaactcaagataaacgacgagggctcgtacggacgtccccagccgtctttcgtcgtaggtactccccgaaaggatacgtacttcccggaccaaacggcgaagggtaattacgttacctctaacttctacgtcgggccctcccgtagtctaggacgtatggaggtctagtaccttattacgttgtttacgacgttggacaacgaaaccacgtcctaggtacttcgttcccgggaaccgttcggggaaccctacggggtaccctaccggtacccgtaacggtaccgaccgaaccccgaacggtaacccccaacccgacgttacgtacccaaccgttccgttacccgtcccccgtaccccg

SEQ ID NO: 403701 - DNA, 682 bp, Homo sapiens
  misc_feature: GZ8MTXP02IYGSH.13.11.A11.1.454.CMB.2.raw
  modified_base (322)..(322): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccggacagacagcctacatccacctgctcgtggagatgtatgactaacgagtatggttctggtatcagcagagcagccacgcccctgtcctactcatctttacaaactccgaggccggcccttcgtcggggttccccnggacgtcgtacttccgcccccgggtccttccccgccttaccggtaggggaacccaccgtacgtcccaacctcgtaccgaaccctagtaccgaacgggcccgggggtaccccacggtacccttaagttggaagttcggaacggtccgttcggtttacctacgtttcgtcggtaccggtagggtccggtaggggaacctacggacggtcggttcgtcggttgggttccggggacgggtaacgggccgtaaggtccgtacgggtaccgttcggtacggttaccgaccggaccccgtagggtcccgtccggcccccgttacggggtcccttacccgttccgtccccgtttcccccggtcccccg

SEQ ID NO: 403702 - DNA, 624 bp, Homo sapiens
  misc_feature: GZ8MTXP02FXXZJ.13.11.A11.1.454.CMB.2.raw
  modified_base (239)..(239): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtcctatgacatatattggtaccanagaagccaaggggactccctcccctagtttcctcctgacggttcaggtacaaactcaagaactaaacgacgaggctcgtaggacgtccccagccgtcttctcgtggactaccgaaggtatcgacttcccgaccacgcgaacgggattacttactacacttctcgtggggtccctccgtaagtcctagacgagttggaggtctagacttattacgttggttagaccgtttggaccaacaactaaccgctaggtacttccgttacggaccgttacgggaccgtacggtaccctaccggtaccgttacgggcccaacgacccccggaaacggcccctaaaacccccgtctacggttcccgaacttcccgtttaccggtttcccccccg

SEQ ID NO: 403703 - DNA, 582 bp, Homo sapiens
  misc_feature: GZ8MTXP02FLVIP.13.11.A11.1.454.CMB.2.raw
  modified_base (335)..(335): a, c, t, g, unknown or other
  modified_base (401)..(401): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtccctatgacatatattggtaccgacaggaagccagggacgtccctccccagttcctcctgaggttcaggtcaaactcagaataaacgacagggctcgtggacgtccccagccgcttcnctggacctccaagatgactccgaccagcgagggattatactcatctcgtcggctccagtctgacgntggagctagacttattacgtgtttgacgttggactaacaaaccgaacgtccgtaggtactacgttccgggaacctcggggaacctacggggtcctacccggtaccgttacggtccgaaccggaccccgaaacggaacccctaaaccccgacgttaccgaccaccttccgtccgttcccccg

SEQ ID NO: 403704 - DNA, 702 bp, Homo sapiens
  misc_feature: GZ8MTXP02GVSRV.13.11.A11.1.454.CMB.2.raw
  modified_base (363)..(363): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgacatatattggtaccgacagaagccgagggacgtcctcccctagtttcctcctggtacggttcaggtacaaactcagtaataaacgacgaggctcgtggacgtccccgagcccgtcttctcgtggacctaccgaaggntacgtacttcccgaccacgtcgagggtacttaacgttacctctaacgttccttacgtgggtccctaccgtaggtcctaggaacgtagtggacggtccgtagaacctttaacgtttacgttggtttacgtacgtttcggaacctaaaccaaaaccgtaccgtacgttacgggacgtttacccggttaccggggaacccgttacgggggaaaccccttaccggggtaccctaaacccgggttcccgttaacggtaccgaacccgaaccccgaaaccggtaacccccgaaaccccctaacggttccgtacctaccctttcccggttacccgtttaccccccc

SEQ ID NO: 403705 - DNA, 587 bp, Homo sapiens
  misc_feature: GZ8MTXP02F3DMM.13.11.A11.1.454.CMB.2.raw
  modified_base (194)..(194): a, c, t, g, unknown or other
  modified_base (222)..(222): a, c, t, g, unknown or other
  modified_base (238)..(238): a, c, t, g, unknown or other
  modified_base (367)..(367): a, c, t, g, unknown or other
  modified_base (369)..(369): a, c, t, g, unknown or other
  modified_base (384)..(384): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatcgtcccgtcgtccccccgganagaccagcctacatcacctgctctgganatgtattgactaacgngtatggttctggtatcagcagaagcaggccacgccccctgtcctactcattctttacaaaactccgaggtccgccctcgtcggggtccctgacgcgtacttccgccccggcctccgctcgtaggaaccncncgtcactctcgaccngtcgacgaccggacccaggtcctagttcgataggacgtcttcgttacttacttcgtcggttcgacggtcggtacgggacaacgacgtcgtgtcgtaggttcgggcggtacggacgtcgtcgtacggtccgtacgttacggccacggacccgaaggtccctccggtcccccgtcggtccctaccgtcctccgttacccctcccg

SEQ ID NO: 403706 - DNA, 600 bp, Homo sapiens
  misc_feature: GZ8MTXP02FHEMH.13.11.A11.1.454.CMB.2.raw
  modified_base (352)..(352): a, c, t, g, unknown or other
  modified_base (379)..(379): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggccctatgacatatattggaccgacagaagccagggactccctcccctagtttcctcctgagttcaggtacaaactcagaataaacgcagggctcgtggacgtccccagcccgtcttctcgtggacctccgaaggntgactcccgacacgcgaggatattacncatctcgtgggctccagtctagacgatggacggtctagtaacttattacgtgtttagacgttggacaaacaaccgaacgtccgttaaggtacttccgttacggaaccgttcggggaaccctaccgggttaccacccggttccgtaacgggtaccaccggaccccgaacggtaacccccaaaccccgtctccgtaccctaccgtccttccgtttaacccccc

SEQ ID NO: 403707 - DNA, 583 bp, Homo sapiens
  misc_feature: GZ8MTXP02FVHO1.13.11.A11.1.454.CMB.2.raw
  modified_base (287)..(287): a, c, t, g, unknown or other
  modified_base (532)..(532): a, c, t, g, unknown or other
  modified_base (548)..(548): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggaccaacagaaaccaggacagcctaccgaagttactctttacgngggcgtccgtaccccgggaagtcccggggtccctgaccgtattcaggtggcaggcgggtctgggacagtactttcactctacaccatcagcacgtccttacgaggctagaaagtagttggtacggtactaagtttttacttacgtgtccaagtactaaaattattatacttcctaccttccctccgtcgggtaccggttcggacctaaggggacctaggggtacgaaactacaaaacgaacgtgngctcgaccactactcncgttctctacctccgttcccactatccgtagtaac

SEQ ID NO: 403708 - DNA, 605 bp, Homo sapiens
  misc_feature: GZ8MTXP02F2I2D.13.11.A11.1.454.CMB.2.raw
  modified_base (241)..(241): a, c, t, g, unknown or other
  modified_base (271)..(271): a, c, t, g, unknown or other
  modified_base (336)..(336): a, c, t, g, unknown or other
  modified_base (354)..(354): a, c, t, g, unknown or other
  modified_base (383)..(383): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgggcagtggcaccaatgttgtcctatgacatatattggtaccganagaagccaggggagtccctccccagtttcncctgaggttcaggtcaaactcaagaataaacgacgagggtctcgtggacgtccccagccgcttcnctggactaccccgaaggntgacttccgccaacgcgaggatacttacnctatctcgtaggctaccagtctagacgtatcgaggtctagaacttatttacgtgtttagacgttggacaaacaaacaacgccgtaggacttccgttacgggaccttacggggacctaaccgggttccaaccgttccgtaagggtccaacggacccccaaacggacccccaaaccccgtacgttacggtacccacgttccttcccggttcccccgtacccccg

SEQ ID NO: 403709 - DNA, 628 bp, Homo sapiens
  misc_feature: GZ8MTXP02F3SFI.13.11.A11.1.454.CMB.2.raw
  modified_base (436)..(436): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggacgtccctccccaggtttcctcctgacggttcaggtacaaactcaagaataaacgacagggctcgtggacgtccccagtcccgacttctcgtggacctaccgaaggatcggacttccgaccacgcgtaagggattacgttacctacacttctcgtacgggtcctaccgagtctacgaacgngtaggaaggtctagactttagttacttagttcgtacttcggacaaccgaaaccaacggtcccgtagggtacttccggttacgaccggttacgggacccgtaaccgggttccaccggtaccgtacggtaccgacgaccccgaaggcccttcccggcccccgttcggtcctaccgtccttcccggtttcccccg

SEQ ID NO: 403710 - DNA, 398 bp, Homo sapiens
  misc_feature: GZ8MTXP02FIWC7.13.11.A11.1.454.CMB.2.raw
  modified_base (256)..(256): a, c, t, g, unknown or other
  modified_base (302)..(302): a, c, t, g, unknown or other
  modified_base (313)..(313): a, c, t, g, unknown or other
  modified_base (381)..(398): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcacctagtttggnactcaacgtggacgttcgccatggaccaggtggaaatgaaagaacngtgctgcaccntctgtctcatctccgccatccctgatagtactgaccttggaggcgggctggcgtaaaggcgctatagnnnnnnnnnnnnnnnnnn

SEQ ID NO: 403711 - DNA, 571 bp, Homo sapiens
  misc_feature: GZ8MTXP02IUDNU.13.11.A11.1.454.CMB.2.raw
  modified_base (306)..(306): a, c, t, g, unknown or other
  modified_base (320)..(320): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatgcagataaatatacttctggtatcagcagagtcaggccagtcccctgtcgctggtcatcatcaagatgaccaagcgacctnacgggactccccgngacgtcgattctcgtcggctacccaatcgtacgggaaacctcgacgcccactctacgaccctatccgagtaccgggacccaggtacctaaagtggattacggaacggtcgtacgtaactattacgtacgtcgagggtcggtagggacagacgagccacgttcggccgtactacgtcggttaccgttacgggaaaccgtcgggaaaccgtacggtaccgtaacccgtacgtaaacgtcccgaacggtacccg

SEQ ID NO: 403712 - DNA, 377 bp, Homo sapiens
  misc_feature: GZ8MTXP02HHWDN.13.11.A11.1.454.CMB.2.raw
  modified_base (373)..(377): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttattctgtcacagtatggtagtcaccgtacactttggccagggaccaagctggagatcaagcgaactgtgctgcacatctgtctcatctcccgcatctgatagtacgtgactgagcgggctgcaaggcgcatagnnnnn

SEQ ID NO: 403713 - DNA, 528 bp, Homo sapiens
  misc_feature: GZ8MTXP02JA0AS.13.11.A11.1.454.CMB.2.raw
  modified_base (395)..(395): a, c, t, g, unknown or other
  modified_base (472)..(472): a, c, t, g, unknown or other
  modified_base (514)..(514): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggatccctccccagttctcctgaggttcaggtcaaactcagataaacgacaggctctggacgtccccagccgcttctctggactccaaggatgattccgccacgcaggggtatattactctatctcgtggctcagtctgacgntgaggtctaggacttagttacttgtttcgtacgttggctaaccaacaccgacgtgtacttcgtacgaccgtggaccncggtcacgtccgtaggcacgcccaagcccaacccactcgacnctactcgtttcccc

SEQ ID NO: 403714 - DNA, 613 bp, Homo sapiens
  misc_feature: GZ8MTXP02I11XR.13.11.A11.1.454.CMB.2.raw
  modified_base (243)..(243): a, c, t, g, unknown or other
  modified_base (304)..(304): a, c, t, g, unknown or other
  modified_base (361)..(361): a, c, t, g, unknown or other
  modified_base (373)..(373): a, c, t, g, unknown or other
  modified_base (424)..(424): a, c, t, g, unknown or other
  modified_base (456)..(456): a, c, t, g, unknown or other
  modified_base (487)..(487): a, c, t, g, unknown or other
tcagtcacgtactacacgaccggtgctcgatttagctacgactgcagggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggagtgtggtacggccgtggggggtccctnagactctcctgtgcacctctggattcagtatttgatgagtatggcatacacgtgggtcccnccaacctcgaaggggaacgggctgcaggtggtctcgtgtaataaacgtggaatggcncagcaactattntgcacgactcgtaggtaggaacgggctattccactatccacaagtacgacnggtacgaccgtaagtaaacccttcccgtaaanacttcgtacgaactaaaacgtacggaaaccnggttacccgtaacggggacgttaaccggacggaaaccgtaccggttccgtttagttactttcgtggtacgacggttaggttaagcgtaaggttcgacgttaggtttaacctacggactttaagggg

SEQ ID NO: 403715 - DNA, 611 bp, Homo sapiens
  misc_feature: GZ8MTXP02HBE0D.13.11.A11.1.454.CMB.2.raw
  modified_base (366)..(366): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccacagaagccgagggactccctcccctagtttcctccgtgtacggttcaggtacaaactcaagaataaacgacgagggctcgtaggaccgtccccgagcccgtacttcgtcgtggactaccgaaaggtntcgtacttcccgaccacggcgaaagggtattacttactacgtattccgtcgtcgggtccctaccgtaagtccgtagacgtagtacggagtctagtaacttattacgtttgttacgtacgttcgacaactaacgacgtcgtaggacttcgtaccggacgtacggacctacggtaccaccgttacgacggtccaccgacccgaacggcccctaacccgtactcgtaccacttccgtaccttaccccc

SEQ ID NO: 403716 - DNA, 389 bp, Homo sapiens
  misc_feature: GZ8MTXP02HOROC.13.11.A11.1.454.CMB.2.raw
  modified_base (320)..(320): a, c, t, g, unknown or other
  modified_base (335)..(335): a, c, t, g, unknown or other
  modified_base (341)..(341): a, c, t, g, unknown or other
  modified_base (344)..(344): a, c, t, g, unknown or other
  modified_base (350)..(350): a, c, t, g, unknown or other
  modified_base (382)..(389): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctattttattctgtcaccagtatggtagtcaccgtactactttggccaggggtaccaagtctggagatacgaagcgaactgtgctgcacntctgtctcatctccncatctnatntacgtntactgacgcgggctgcgaaaggcgacgatagnnnnnnnn

SEQ ID NO: 403717 - DNA, 722 bp, Homo sapiens
  misc_feature: GZ8MTXP02HDU2E.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccacagaagccgagggacgtccctcccctagtttcctccgtgacggttcaggtacaaactcaagtaataaacgacgaggctcgtggacgtccccagccgtcttcgtcgtggacctaccgaaggtatcgacttcccgactacggcgtaagggtattaacgttacctcgtaacttccgtcgtcggggtcccttaccgaaggttccgtagaccgtagttcggaacggtcttaggtaactttagtttaccgttggtttacgtacgtttcggacctaaaccgaaacgtaaccgtccgttaggtaacgttccggtttaccgggaaccgttaccggggtaaccccgtacccgggttacccgtaaccccggttacccggttaacgggtacccgaaacccggtaacccccgaaaaccggggaaccccccctaaaaccccctacgttacccgtaccctaacccgtttcccgtttaccccggtttcccccccgg

SEQ ID NO: 403718 - DNA, 722 bp, Homo sapiens
  misc_feature: GZ8MTXP02H2I1E.13.11.A11.1.454.CMB.2.raw
  modified_base (199)..(199): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccacctcagcgtcgtcgggacccccggnagagtgtcacatctcttgttctggaggcagtgccaacagtcgggaagttaattatcgctattcgtgtactacaacactccgaggaaccgcccccagacctcctcactctaatagactaaactaaccgacggccggtcctacggtacggggtcccctaggacccccgtatttcctctcggcctaccgtaacgtccgttcggcctaacccgttccgaccgtcccccttcccgtcggaccctacgtccgacgggttccgggcccgtcccgggtaccgacgtacgtcgacggtcttaggtactttaactttacgttcgtttagacgtcggttagggtagtacgacgtacggccgttaggtaaacgtttacgggtttacgggggtttttcggggaccgggttacggggtaaacccgttaaacgggttccggtaaccccggtacccgttaacggggttacccgtaacccggacccgtaaaccgggtacccgtccccggtaccccccggttccggtttaacccgtccccg

SEQ ID NO: 403719 - DNA, 585 bp, Homo sapiens
  misc_feature: GZ8MTXP02GNPWZ.13.11.A11.1.454.CMB.2.raw
  modified_base (217)..(217): a, c, t, g, unknown or other
  modified_base (233)..(233): a, c, t, g, unknown or other
  modified_base (373)..(373): a, c, t, g, unknown or other
  modified_base (439)..(439): a, c, t, g, unknown or other
  modified_base (461)..(461): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctgganatgtattgactaacgngtatggttctggtatcagcagaaggcaggccacgccccctgtcctactcatctttacaaaataccaggccgccctcgtcggggtccctggacgtcgacttccgtccccgggtcctcccgccctcgtacggggaaccacgngtccaactctacgacccatcgaacggccgggacccacgtccctatcgatgaggtctagtctacttntagtcaggcggtagggacaagngcgtgcgtggttacgggcggacggactggtcgtacggtaccgttcgttacggaccgacgaccccaaggggtcctccgcccccgttcgggtaccctaccgttccgtcccgtttcccctacccccg

SEQ ID NO: 403720 - DNA, 392 bp, Homo sapiens
  misc_feature: GZ8MTXP02GO7ZW.13.11.A11.1.454.CMB.2.raw
  modified_base (348)..(348): a, c, t, g, unknown or other
  modified_base (387)..(392): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctactttattctgtcaccagtatggtaggtcaccgtactacttttggcctaggggaccaagctggagatcaagcgaactgtggctgcacatctgtcttccatcctccgccatcctgntacgtacgtgactgagcgggctgggcaaggcacgatagnnnnnn

SEQ ID NO: 403721 - DNA, 647 bp, Homo sapiens
  misc_feature: GZ8MTXP02JTSXI.13.11.A11.1.454.CMB.2.raw
  modified_base (277)..(277): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcgtggtttctgtgctatttaaaggtgtcagtgtgaggtgcagctggtagagtcgtgggggagtgtggtacggcgtgggggtccctgagactctcctgtgcaacctcgtggatcagtattgatgagttagngactatacgtacgtcggtcccgaccaccgtacggagggaggcgtgcgtaggtcggtctacgtagtaagtaacgtaggtacgtcgcgacacgtacaactaacttgcgacgtacgtacgtagtacggtacggaaccggtacctactaccacctactaccgaacgaagaacgtaactaacgtaccgaacgaacctacgtcgttacgtacgtaggagtacggacggaccgtacgtacggaaccgtacgaccggaacgtaaaccgtacgttaacttaacgtttacgtacggtggttacggttacggtaggtttagtaggttaacggtaacggtaaccggtacgtaaaccggtacggtaccggtacccggtaccgg

SEQ ID NO: 403722 - DNA, 682 bp, Homo sapiens
  misc_feature: GZ8MTXP02FK965.13.11.A11.1.454.CMB.2.raw
  modified_base (309)..(309): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtggtgggtacgggccgtggggggtccctcagactctcctgtgcaacctctggattcagtatttgatgagtatggcatacacgtggggtcccnccaaaccctccgaggggaacggggctggcgaggtgggtcttcgtaggtaataaaacgtggaagttggtgccaggaccaactaactttatgactacgtacctcgttaggtagggaacgggtcccgtatttccgaacccattccctaccgaagaacgacacggtcgaccgtaacgaaaccttcccgtaacattccgtaggtaactaaaagttcgaaacgtacggttccgtacgggaagtaccgggaaacggaacccgttaaccgggtcccgtttagtttaaaccgttttcgtagggttacggtacgggttaggggtttaacgccggttaagggttacggtcgtttacgggtttaaccttacggaccgtttaaagg

SEQ ID NO: 403723 - DNA, 563 bp, Homo sapiens
  misc_feature: GZ8MTXP02H8DTS.13.11.A11.1.454.CMB.2.raw
  modified_base (199)..(199): a, c, t, g, unknown or other
  modified_base (347)..(347): a, c, t, g, unknown or other
  modified_base (408)..(408): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcncagtggccaccaatgttggtccctatgacatatattggtacacagaagcaggagtcctcccagttctcctgtagttcaggtacaaactcagaataaacgacgagggctcgcggacgtcccagccgtcttctcgtggactaccaaggtntcgacttccgaccacggcaagggactacttacgtcatctcgtgggcctacagtctgacgtntgacggctagaccttatttacgttgtttcgtacgttcgggactaacaaacaaccggtccgttaggacttcgtacggacgtacgggactacggtcaccgtctacgtcacgacccaacggaacccaaccgtctacgtacacttcgtccgttcccccg

SEQ ID NO: 403724 - DNA, 677 bp, Homo sapiens
  misc_feature: GZ8MTXP02JAE7E.13.11.A11.1.454.CMB.2.raw
  modified_base (198)..(198): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcncagtgcaccatgtgtcctatgacatatattggtaccacagaagccagggactcctcccctagttctcctgagttcagtacaactcagaataaacgacgaggctcgtggacctccccagccgtcttccgtcgtggaacctaccgaaaggtactacgacttacccgaccgtacggccgaaggggtacttaacttaccactaaacttccgtacgtgggcccttaccgaagtcctagactagtaggacggtctacgtacttaattacgttaggtttacgtacgtttcggactaaaccaaacgtaaccggtcccgtaggtaacttccggttaccggtaaccgtacgggggtaacccctacggggttacccaacccgggttcccgttaaacgggtccgtaaccggaaccccgtaaacccggtaaccccctaaaacccccggctttacggacccgtaaccgtttccctaaccggtttacccccccg

SEQ ID NO: 403725 - DNA, 578 bp, Homo sapiens
  misc_feature: GZ8MTXP02JZ9IZ.13.11.A11.1.454.CMB.2.raw
  modified_base (381)..(381): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacctgcgcagtggcaccaatgtgtcctatgacatatattggtaccgacagaagccaggagtcctccccagtttcctcctgtaggttcaggtacaaactcagaactaaacgacgaggctcgtggacgtccccgagccgcttctcgtggactacgaaggatcgatccgaccacgcgaacgggtatagttacnctatctcgtacggtctccgagtctgacgatgaggcttagactattactgttagtacgttggactacgaacgaccgctaggtacttacgttaccggtaccgtacgggtaccctacggtccacccgtaccgtacggtaccgaccgacccgaaccggcccaaaccccctcgtccgtacgtacctcgttccgttacccccg

SEQ ID NO: 403726 - DNA, 628 bp, Homo sapiens
  misc_feature: GZ8MTXP02H5UJS.13.11.A11.1.454.CMB.2.raw
  modified_base (370)..(370): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacattatagttcggtaaccgacagaagccgaagggactcccctcccctagtttcctcctgtacggttcaggtacaaactgaagaataaacgcagggctacgtgggaccgtccccagccgtccttctccgtggactccgaaaggtntcggacttcccgccgaaacgcgaagggttatacgttcactactccttcgtcgggtcctcgagttccgtagaccgtaagttggaaggtccgtgtaacgtttaacttacgtttggtttacgtacgtttcgggaacctaacgaaaccgtaacgccgtacggtacttccgtacgcccgttacggaccgtacggtccgtaccgtacgtacgtacgaccgacccgaacggccccaaacccgtctacgcctaacgtcttaccccg

SEQ ID NO: 403727 - DNA, 461 bp, Homo sapiens
  misc_feature: GZ8MTXP02G31PO.13.11.A11.1.454.CMB.2.raw
  modified_base (443)..(461): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggagaccactgacatcccagacaggttcagtggcagtgggtctgggacagacttcactctcaccatcagcagactggaacctgaagtactttgctacttttattctgtcacagtatggtaggtcaccgtactacgtttggaccgtaaggggaccaaaggtcgtaggagtacgtacgaaagccgaactggtcggctgcacctatctcgtcttcctacttccttccccgacctagttcctagtacttacgttacggtcgtaacgttcggacggccggggtcgtacgggacgaaacggggcacgatagnnnnnnnnnnnnnnnnnnn

SEQ ID NO: 403728 - DNA, 522 bp, Homo sapiens
  misc_feature: GZ8MTXP02F98RX.13.11.A11.1.454.CMB.2.raw
  modified_base (465)..(465): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagaagtcaggccacgtcccctgtgctggtcatctatcaagatcgccaaggccggcccctcgacgggactccccccgtgacgcgtattctctggcctaccaactcgtacgggaactcgacgccactctacgaccatcgagccgggacccaggctagtgatggagctagtactattactgtccgaggtcgtaggacagcagcacgtcgcccgntacgtcgtccgttacggacgtaggaaccgacggtccaccgtactacgccacgacccg

SEQ ID NO: 403729 - DNA, 554 bp, Homo sapiens
  misc_feature: GZ8MTXP02IRWZX.13.11.A11.1.454.CMB.2.raw
  modified_base (212)..(212): a, c, t, g, unknown or other
  modified_base (290)..(290): a, c, t, g, unknown or other
  modified_base (395)..(395): a, c, t, g, unknown or other
  modified_base (493)..(493): a, c, t, g, unknown or other
  modified_base (497)..(497): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttanacagctccgacaataggaactacttagcttaggtaccaacaagaaaccaggacagcctacgaagttacttctttacgngggccgtccgtacccgggacgtcccggggtccctgaccgtattcgagtggcgaggcgggtctgggacagtacttcactctcacatcagcagccttgagcagaagntgtgtactagtttattctagtcagtactaaattattacttatcttctcctcgtcgtacgttccgacgacggacgagggtagaactacaaacgagtcgngacncaccactacgtctcggttctaacgtcgttacccttcccgtctaacttcgtacgtacg

SEQ ID NO: 403730 - DNA, 590 bp, Homo sapiens
  misc_feature: GZ8MTXP02HOMJY.13.11.A11.1.454.CMB.2.raw
  modified_base (302)..(302): a, c, t, g, unknown or other
  modified_base (331)..(331): a, c, t, g, unknown or other
  modified_base (343)..(343): a, c, t, g, unknown or other
  modified_base (346)..(346): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacaggactccgtggcctctatgagctgactcacgccaccctcagtcgtcccgtcgtccccaggacagacacgccagcatccacctgctactaggaaataatggacagtaataaatactacttctggtatcagcagagtcacggccacgtccctgtcgctgtcatcatacaagntcgacacgccgacctgacggactccccgngagtcgtattcncgngcctacactcgagtactcacgccactcgtacgacctatcgacggcccgtaccgaggtcctagacggactagggacgttcgtacgttaacttacgttacggtcgtacgacggggtacggagggacacggtacgacggaccgtacgtcccggtaccctagttacgttcggttaccggttaccggtaaccgttacggaaccgtaacggtaccctacccgttacgtaacggcctaaccggaacccccg

SEQ ID NO: 403731 - DNA, 621 bp, Homo sapiens
  misc_feature: GZ8MTXP02IL8SM.13.11.A11.1.454.CMB.2.raw
  modified_base (218)..(218): a, c, t, g, unknown or other
  modified_base (238)..(238): a, c, t, g, unknown or other
  modified_base (386)..(386): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgtgcctangacatatagttggtaccganagagccgaggacgtcctccctagtttctctgagttcaggtcaaactcaagataaacgacgaggctcgtggacgtccccagccgcttctcgtcggacttccaaaggtactagtacttcccgaccgtaacgccgaggggtactacttacnctatcttcgcgggtctccgtagtcctagacgtagtaggaagtccgtaggtaacctttagtttaaaccgttggtttacgtacgtttcgggaaccgtacctaaacgaacggtcccgtaggtaacgttccgtttacggacccgttacgggacccgtacggtccgtaaaccgtcggttacgtacgaccgacccgaaacggaccccaacccggtacgtacgcctaaccgtctttccccgg

SEQ ID NO: 403732 - DNA, 637 bp, Homo sapiens
  misc_feature: GZ8MTXP02HBSE1.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgacatatattggtaccgacagaagccagggactcctccccagttctcctgaggttcaggtacaaactcaagactaaacgacgaggctcgtggaccgtcccagccgtcttctcgtggactccgaaggtactcgtacgttcccgacctacggcgtaacggggaattacgttactcacttcctcgtgggccttccgagtctcgacgtatggacggtctacgacgttaattcgttagtttgtacgtttggacctaaccaaacgtaccgtccgtaggtaacgttccgttacgggaccgttacggggaaccctaccgggtaccgtaaacccggttccgacggttccgaaccggtcccccgaaacgggcccccgtaaaccccacgttaccgtacctacccgttccgtccgtttccccccg

SEQ ID NO: 403733 - DNA, 385 bp, Homo sapiens
  misc_feature: GZ8MTXP02HMX73.13.11.A11.1.454.CMB.2.raw
  modified_base (343)..(343): a, c, t, g, unknown or other
  modified_base (353)..(353): a, c, t, g, unknown or other
  modified_base (381)..(385): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcacatctgtctccatcttcccgcatctnatagtacgtnactgagcgggctggcaaaggcgcatagnnnnn

SEQ ID NO: 403734 - DNA, 576 bp, Homo sapiens
  misc_feature: GZ8MTXP02FWKXJ.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgagttcaggtcaactcagaataaacgacagggctcgtggacgtccccaggccgtcttctctggactaccgaaggatgacttccgaccacgcagggtatacgttactcatctacgtgggctacgaagtctagacgagtgaggctagacttattacttgtttacgacgttggactaacaaaccgtaacgcctagggtacttccgttacggaccgtcgggaaccctacggtccaccgtccgtacggtccgaacgcccgaaacggcccctaaccccgacgtaccgtacctacgtcctccttaccccc

SEQ ID NO: 403735 - DNA, 584 bp, Homo sapiens
  misc_feature: GZ8MTXP02FYAMN.13.11.A11.1.454.CMB.2.raw
  modified_base (243)..(243): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggacgtcctccccagttctcctgagttcaggtcaaactcagaataaacgacaggctcgtggacgtccccagccgtcttcgtcgtggactaccgaaggatcggtacttccgaccacgccgaggggtatacttactctatctcgtgggcctccgtaagtccgtagacgtagtagaacggtctagtaccttatttaaccgttgtttcgacgtttcggactaacaaaccgaacgccgtaggtaacttcgtacggaccgtcgggaccgtacggtccaccgtacgtacggccgacgcccaacggcccaaccctacgtctctacgtctcgttcccccg

SEQ ID NO: 403736 - DNA, 347 bp, Homo sapiens
  misc_feature: GZ8MTXP02FS2KE.13.11.A11.1.454.CMB.2.raw
  modified_base (272)..(272): a, c, t, g, unknown or other
  modified_base (321)..(321): a, c, t, g, unknown or other
  modified_base (339)..(347): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggaactgtggctgcaccntctgtcttcactccttcccgctatctgactagtacgtgactgagcgggntcggacaaggcacatagnnnnnnnnn

SEQ ID NO: 403737 - DNA, 576 bp, Homo sapiens
  misc_feature: GZ8MTXP02JRBQ8.13.11.A11.1.454.CMB.2.raw
  modified_base (272)..(272): a, c, t, g, unknown or other
  modified_base (389)..(389): a, c, t, g, unknown or other
  modified_base (415)..(415): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccccctcgcaggctgtgctgactcagccgtcttccctctctgcttctcctggagcgtcagccagtctcacctgcaccttgcgcagtggcaccaatgttggtcctatgacatatattggtaccgacagaagccagggagtccctccccagtttccncctgaggttcaggtcaaactcagataaacgcagggctcgtgggacgtccccagccgtcttctctggactccccgaagggatgactttcccgaccaacgcgtaggggacttattaccncgtatctcgtgggctacccgagtccngtacgatggaggccttgacttatttacgtgtttagacgtttggaccacaaaccgaacgccgttaggacttcgttaccggacctggggaccctacgggtcacccggtctagggtccacgccccaaggccccaaacccgctcgtcacctctcgtcccctaccc

SEQ ID NO: 403738 - DNA, 539 bp, Homo sapiens
  misc_feature: GZ8MTXP02GK8Y7.13.11.A11.1.454.CMB.2.raw
  modified_base (190)..(190): a, c, t, g, unknown or other
  modified_base (329)..(329): a, c, t, g, unknown or other
  modified_base (349)..(349): a, c, t, g, unknown or other
  modified_base (351)..(351): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttctggtatcagcagaagcaggccacgccccctgtcctactcatctttacaaaaataccaggcgccctcgtggggtccctgagcgattcncccgctccgctctggaaacncngtcactctgaccatcagcggaccagctaatgatgagctgtctactctgtcaggcgtgggaacaacgagtcgtgctggttcggcggagggaccaaggtctcggtaaaccgttcgtttaaacggtcaacggaccctaaagggccctggccccccctagggttccaacctcgtccggtttcccccgtcccg

SEQ ID NO: 403739 - DNA, 384 bp, Homo sapiens
  misc_feature: GZ8MTXP02GQKNK.13.11.A11.1.454.CMB.2.raw
  modified_base (244)..(244): a, c, t, g, unknown or other
  modified_base (269)..(269): a, c, t, g, unknown or other
  modified_base (340)..(340): a, c, t, g, unknown or other
  modified_base (378)..(384): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaaacctgaagactttgctacttttattcngtcaccagtatggtagtcaccgtanacttttgccagggaccaagctggagatcaagcgaactgtggctgcaccatctgtctcatcttcccgcatcngatagtacgtgactgagcgggctggcaaggcgcatagnnnnnnn

SEQ ID NO: 403740 - DNA, 530 bp, Homo sapiens
  misc_feature: GZ8MTXP02FTZVF.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctcccctagttctcctgaggttcaggtacaaactcagataaacgacagggctcgtggacgtccccaggccgtcttctcgtggactaccgaaggatgacttccgacacggcgggatatactcatctgtggctccagtctgacgatgaggctgactattactgtttgacttgacacgaacacgctggactcgttcggactgggacctacggtccacgtctaggtcacgacccaacggcccaaacccgctacgtcaccttctcgttaccctaccc

SEQ ID NO: 403741 - DNA, 633 bp, Homo sapiens
  misc_feature: GZ8MTXP02JWQK6.13.11.A11.1.454.CMB.2.raw
  modified_base (172)..(172): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaattaattggacagaataaatatacttcctggtatcagcagagtcagccagtcccctgtgctggtcatctatcaagatcgaccaagccggaccctgagggtactcccccgtgagcgtacttctcgtcggcctaccaacgttcgtacgggaactcgacgcccactctacgaccagtcgaacggccgggtaaccccaggggtaccctaagtacggggtaacgttaggggacggtaccgttagggtaacttaagttttaccgtagggttacccggaaagggggtcccgggttagggggaaaccaggaccgaacgcccgtaacgtccggacccgtacttacgtcggttaccgtacggtaaccgttcggggaaccgtacgggtcctaaccggtaccgtaaacgtccggaacgaaccccg

SEQ ID NO: 403742 - DNA, 647 bp, Homo sapiens
  misc_feature: GZ8MTXP02IJ1LF.13.11.A11.1.454.CMB.2.raw
  modified_base (312)..(312): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaccacagaagccgaggacgtccctccctagtttctcctgaggttcaggtacaactcagataaacgacaggctacgnggacgtccccagccgtcttctcgtcggactaccgagatgacttcccgaccgacggcgaaggggtaacttaacgtttacctctaacttccgttcgttcggggacccttccgacgttcctaggtacgacgtgtacggcttagactttaagtttaccgtttggttttacgtacgtttcgggactaaaccgtaaccgaacgtccgttaggtacttccgttacggaccgttcgggaaccgtaccggtccgaacccggttccgtacggtccgaaccgtaccccgaaaccggaaccccaacccccgacgttctacctaccttaccgttaccgtttacccccc

SEQ ID NO: 403743 - DNA, 666 bp, Homo sapiens
  misc_feature: GZ8MTXP02JIDXX.13.11.A11.1.454.CMB.2.raw
  modified_base (246)..(246): a, c, t, g, unknown or other
  modified_base (397)..(397): a, c, t, g, unknown or other
  modified_base (628)..(628): a, c, t, g, unknown or other
tcagtcacgtactacacgaccggtgctcgatttagctacgactgcaggggagctctgggagaggagcccccagccctgagattcccacgtgttgccattcggtgatcagcgctgaacacagaggactcgccatggagtttgggctgagctgggttttccttgttgcttaattttaaaaggtgtccagtgtgaggtgcagctggtagagtcgtgggggaggtgtggtacggccggtgggggtccctnagactctcctgtcgcacctgtggattcagtatttgatgagtatggacatacacgtcggtcccgaccaacccgtccgaaggggacgggctggcgtaggtggtcttcgtaggtaataaacgtggaacgtggtacgaccagacaacgtaacttngacagtaccttcgtaggtacggacggggtccctattaccccaacctacgtccctaacccggaaagaccggaacctagggtccaaacccggtaacgtaaaaccccttcccgaaactagtttccagaaacttaaaagccgtaaacctggttcccggagggaactacggggaacggtacccaaccggtttctttaggttaaccgtttgtaggtccggaacggttaggttaccgngtacgggtcggtacgttacggtaacgtacgacgtaagg

SEQ ID NO: 403744 - DNA, 610 bp, Homo sapiens
  misc_feature: GZ8MTXP02FS8JH.13.11.A11.1.454.CMB.2.raw
  modified_base (190)..(190): a, c, t, g, unknown or other
  modified_base (369)..(369): a, c, t, g, unknown or other
  modified_base (487)..(487): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccacgccccctgtcccctactcatctttacaaaataccaggccgccctcgtcggggtcccctgacgcgtattccgccccggtcctcccgcctcgtgggaaaccacngtccactctacgacccatcgacgccgggacccagccctagttgagttgacgtctgttccttacttcgtcgttacgagggtcgtagggaacaacgacgtccgtgcgttgggttccgggnggggaacgggaccgtacggtacgtcggtacccggttacgttaaacgggtcctaaccggtacccaacgggtcctccgtcccccgtcggtacctaccgttcctacccggttaccccttcccccgg

SEQ ID NO: 403745 - DNA, 716 bp, Homo sapiens
  misc_feature: GZ8MTXP02IE2OL.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccgacagaacgccgaggacgtcctccccagttcctcctgagttcaggtacaaactcaagaataaacgacgaggctcgacggacgtccccagccgtacttcctacgtcgggaccttaccgaaaggtactcggtacttcccggaacccgaaccggtccggaaaggggtaactttaactttaacccgttacgtaactttcccgtccgttacgggggtacccttacccgtaaggttcccgttagggaacccgtaaggttacggaacggggtacccttaggtaaacctttaaattttccggttaggttttacgtacgtttacgggacctaacgaaaccgaacgtccgtagggtaacttccgttaccggacgtcgggaacccgtacggtcccaaccgtccgttaaacggccaacgacccccgaaacgggccccaaaaccccgtcgtaccggtaccgtaacccttccgtttacccgtccccccg

SEQ ID NO: 403746 - DNA, 353 bp, Homo sapiens
  misc_feature: GZ8MTXP02GQWRP.13.11.A11.1.454.CMB.2.raw
  modified_base (278)..(278): a, c, t, g, unknown or other
  modified_base (289)..(289): a, c, t, g, unknown or other
  modified_base (298)..(298): a, c, t, g, unknown or other
  modified_base (314)..(314): a, c, t, g, unknown or other
  modified_base (328)..(328): a, c, t, g, unknown or other
  modified_base (346)..(353): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaatactttgactattttatttctgtacactagtatcggaacttgtcggctgcacctntctgttcttcnttccctccnctatctgatagttcgngactggacgcggtntcggacaggcacagtagnnnnnnnn

SEQ ID NO: 403747 - DNA, 742 bp, Homo sapiens
  misc_feature: GZ8MTXP02JF7GX.13.11.A11.1.454.CMB.2.raw
  modified_base (172)..(172): a, c, t, g, unknown or other
  modified_base (237)..(237): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatntactctgtatcagcagaagtcaggccagtcccctgtcgctggtcatctatcaagctgaccaaggccggccctgaggggactccccccgtagacgtcgtatttcctacgtcgggtcctaccctaaaccgttcggtaacggggtaaccttcgaaaccgtcccgtaaacttccgtcggaaaccctacgtaccgaaccggggacccgggaccccgtaacgggtaccttaaggttaccgggattacgggacggtacctacgggtaacctttaacgttaccggtcggttaaccgacgggggtaccgggttacggggaaaccgtacggaccgaacggaccctaaccgggttccgaccccccgggtattaacccggtttacggttaccccggttttaacccgggggaaaaccggttacccgggggtaaaaccccgtaaacccggggttacccctaaaaccccgggtttaccccgtaaaacgggttaccccgaaacccgggtaaacccccccgg

SEQ ID NO: 403748 - DNA, 700 bp, Homo sapiens
  misc_feature: GZ8MTXP02HODFJ.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtcctatgacatatagttggtaccgacagaacgccgagggacgtccctcccctagttcctcctggaggttcaggtacaaactcagaactaaacgacagggctcgtggactccccagccgtacttctcgtggacctccgaaggtatgacttaccgactacgcgtaagggtattacttactacactctcgtcgggtcctacgtacgtcgtagacgtagtggacggtcttagaacctttagtttaccttggttttacgtacgtttacgggacctaacgaaaccgaaccggccgtaaacggggtacttacccggttaccgggtaacccggttacgggggtaacccgtaacccggggttaccgtaaccccggttaccgttaaacgggggtacccgaaccgggtaacccccgaaacggggtaaccccccaaaaccccgtcggttacccgtacccgtaacccgttaccgtttccccgtttaacccccccg

SEQ ID NO: 403749 - DNA, 672 bp, Homo sapiens
  misc_feature: GZ8MTXP02F9XAO.13.11.A11.1.454.CMB.2.raw
  modified_base (307)..(307): a, c, t, g, unknown or other
  modified_base (388)..(388): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtggtgggtacggccgtggggggtccctcgagactctcctgtgcaacctctggattcagatttgatgagtatggcatacacgtgggtcccnccaaccgtccgaaggggagggctgcaggtggtctcgtggtaataaacgtggaacgtggtcgaccaggaccaactaacttancgcaagtacctcgtggtaggaaacggggtcccaatttacccgaaccctatccctaccgaaaggacgaacgaggttacgacccgtaacgtaaacccttccccgtaaatacgttctacggaaacctaaaagtaccggtaaactcggttaccgtacggggaacggtaccggaagggacccgtaacggtcccgttttaaggttacgttttccggtaggtaccgggtacgtagggtttagccgttaagggtcggtccgttagggtttaaccttaaaccggacgtaaacg

SEQ ID NO: 403750 - DNA, 758 bp, Homo sapiens
  misc_feature: GZ8MTXP02F08NH.13.11.A11.1.454.CMB.2.raw
  modified_base (205)..(205): a, c, t, g, unknown or other
  modified_base (379)..(379): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagcccaccctcagccgtcgtcggggaccccccgggnagagtcgtaccacctattccttcgtttggttcgtagggacggctaggtcgacccaaacgtaggtacggggtaagttaaattagtcgtactacgtttcgtaggtaactaccaaacctaacccgtaccccggaaacgggaaccccggcccccaagtaccctcctactactactaanacgaacctaaaactaaccgacggcccggtccccgtacggaccggggttcccctacgtaccccgtactttccgtcgtacggtcctaccgtaagttccgtacgaccctaccgtccgaccgtcccctccgcgaccctacgtccggacgggtcccgggtcccgttacccgggtaccgacggtacgtacggacggtacttagttaaactttaacgtttacgttcgttacgaggttacggttaggactacggaacctacgtacgttaaggtacgtttcggggtttcggggttacgggacgggtaacggtaccgtaaggtccggtaccgttacgtacggtaccgaaccggcccgtaccggccccgtcccgtacgtccgtacctccg

SEQ ID NO: 403751 - DNA, 703 bp, Homo sapiens
  misc_feature: GZ8MTXP02I8LCW.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtccctccccagtttctcctgaggttcaggtccaaactcagataaacgacagggctcgtaggacgtccccagcccgtcttctcgtggacctccgaagggtatcggtacttacccgaccacggcgtaaggggaattacttacctactacttctcgtcgggcctacccgtaggtcctggtacgattcgggaacggtcctagtacctttagtttacgttggtttacgtacgtttcgggactaaaccaaacgaaccgtcccgttagggtaacttccgtttaccggaacccggttcgggtaacccgtaccgggttacccaaccccgggtttaccgtaacgggttacccgaaaccgggtaccccccgaaaaaccggggtaaccccccaaaacccccgtaccgtttaccggaccccgtttaaacccttcccgtttacccggtttaacccccccc

SEQ ID NO: 403752 - DNA, 598 bp, Homo sapiens
  misc_feature: GZ8MTXP02H8LVB.13.11.A11.1.454.CMB.2.raw
  modified_base (333)..(333): a, c, t, g, unknown or other
  modified_base (382)..(382): a, c, t, g, unknown or other
  modified_base (402)..(402): a, c, t, g, unknown or other
  modified_base (413)..(413): a, c, t, g, unknown or other
  modified_base (419)..(419): a, c, t, g, unknown or other
  modified_base (435)..(435): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggccgtggggggtccctcagactctcctgtgcaacctctggattcagattgatgagtatggcatacactggtccgccaacctccgagggaaggggctgcaggtgggtcncgtggtaataaacgtgaatggtgccaggtcaactaacttatgcagactncgtgaagggccatcacatcncagacacagtnaccganaactcgtaacattccngaacaaatgaaaactagtcgtacgggacgacggaacggacctaaacggtcccgtttaggttaacttttccgtaggttccggacggttaaggggtttaaacgccggtaagggttccggggtacgttagggggttaaacccttttaacgggtaccctaaaagggg

SEQ ID NO: 403753 - DNA, 712 bp, Homo sapiens
  misc_feature: GZ8MTXP02GI1UR.13.11.A11.1.454.CMB.2.raw
  modified_base (179)..(179): a, c, t, g, unknown or other
  modified_base (200)..(200): a, c, t, g, unknown or other
  modified_base (240)..(240): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctnagcgtcgtcgggacccccggnagagtgtcaccatctcttgttctgggaggcagtgaccaanagtcgggagtaattatgctattctggtatcaaacaactcccgaaggaacccggccccagacctcctcatctaatacgacaaactaaccgagccggccctcgaacggggtccctgaccccgtatctctcgtcctccaagtctcggcctacctacgaccgtccctccgtcggaccctagtaccgtaggtccgggtccgtacccgggttacccgaaccggtaatcgggaacgtaccgtaggtaaacttttaacgttaccgtttcgttacgtacggtacggtttagggaattacgggaacctacgggtcccttaggtaaacgttttaaccgggtttcggggtttttaccgggggaccggggttaaaaccgggtaccgttaaaacggtttccgtaaccccgtttaccgttccgttaaccgtaaccgaccccgtaaaacggtcccgtacccgtacccccgttcggttaccgtaccccg

SEQ ID NO: 403754 - DNA, 535 bp, Homo sapiens
  misc_feature: GZ8MTXP02JDDQJ.13.11.A11.1.454.CMB.2.raw
  modified_base (328)..(328): a, c, t, g, unknown or other
  modified_base (377)..(377): a, c, t, g, unknown or other
  modified_base (407)..(407): a, c, t, g, unknown or other
  modified_base (464)..(464): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttgtccctatgacatatattggtaccgacagaagccgagggagtccctcccctagttctcctgaggttcaggtacaagtcagataacgacaggctctggactccccagccgcttcnctggacctccgaaggatgacttcccgaccacgtcgagggtatattactnatctcgtgggacctcagtctgacatggagntgtactattactgttagtctggctacgacaaccgctggactcgtcgaccgtggaccncggtactaccgtcgtacggtccacgcccgaacgaacccgaaccccacgtacgcctacctctcgttaccccc

SEQ ID NO: 403755 - DNA, 639 bp, Homo sapiens
  misc_feature: GZ8MTXP02FWPRL.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggccaccaattgttcggtccctatgacatatattggtaccacagaacgccgagggactccctcccctagtttcctccgtggtagttcaaggtacaaactcaagaataaacgacgagggccttcgcggacgtccccagtcccgtctctcgttaggaccctaccgaaggtactacgtacttaccccgaccgaacggcgtaagggtacttacttactactacgttcctcgtgggtcccttacgaacggttctagaaccgtgttgagggtcctaggtactttaacgttccgttgtttacgcgtttacggaccaacgtaaaccgaggtccctaggggtaacttcgggttacgaccgttggaacccgtcgtacctaccgtcttaaggcccaaaccggccctaaaccgaaccaacccctgtcctccacttctccgtaaccccc

SEQ ID NO: 403756 - DNA, 538 bp, Homo sapiens
  misc_feature: GZ8MTXP02JHFOR.13.11.A11.1.454.CMB.2.raw
  modified_base (370)..(370): a, c, t, g, unknown or other
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtccctccccagtttctcctgagttcaggtcaaactcagataaacgacagggctcgtggacgtccccaggccgcttctctggactccaaggatgattccgaccagcagggatatacntatctacgtggctccagtctgacgatgagctagacttatctgttgacttggcaacaaacgacgccgtaggacttccgttacggaccgttgggaccctacggtccaccgtccctagggtccacgccccaaggccccaaaccccgctcgaccacgttccctcgttccccc

SEQ ID NO: 403757 - DNA, 565 bp, Homo sapiens
  misc_feature: GZ8MTXP02HNQCI.13.11.A11.1.454.CMB.2.raw
  modified_base (302)..(302): a, c, t, g, unknown or other
  modified_base (331)..(331): a, c, t, g, unknown or other
  modified_base (339)..(339): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaattaaagttggacaagtaataaatatacttcctggtatcagcagagtcaggccacgtcccctgtgctggtcatctatcaagntgaccaagcgccctagaggctcccctgancgtattcncgtgcctccaatcgtaggaactcagcccactcagaccatcgacgccggacccaggactaggtgataggacggtctacgtaacttattacgtagtacgacggtcggaggggacaggcgacggacctacgtccgcccgtagtacgtcggttaccgttacgggtaacgtcggggaaacccgtaacggtaccgtacccgttaccgtaacggtaccgaaccggaacccccg

SEQ ID NO: 403758 - DNA, 636 bp, Homo sapiens
  misc_feature: GZ8MTXP02G96BM.13.11.A11.1.454.CMB.2.raw
  modified_base (216)..(216): a, c, t, g, unknown or other
  modified_base (229)..(229): a, c, t, g, unknown or other
tcagtcacgtactacacgaccggtgctcgatttagctacgactgcaggcagggggcagcaagatggtgttgcagacccaggtcttcatttctctgttgctctggatctctggtgcctacggggacatcgtgataagccagtctccagacctccctggctgtgtctcgtgggcgaggagggccacatcaactgacaagaccagccagagttgtttanacagctaccgaanaagtaggaactacttagcttaggtaaccaacagaaaccagacacgcctacgtaattactactttacgcggccgtaccgtacccgggacgttccccgggtcctacgaccgtattcgaggtcggcacggtcgggtacgtcgggaactagtacctttccgacttccgtaccacctatccaggtcctaacgtcccttacgacgggtctaggaaagtgtcggtggtactttagtttaagttacctaggtaccaagtaactaaattatttaactacttccttcctcccgtttaccgtacgggtacgttaccgaaccgtaagggcgtaagggtagaaactcgaaaacgcgtcgcggactcgacctacgacttctgttacctaactacgttcctcccgactagtcctaggtaacg

SEQ ID NO: 403759 - DNA, 617 bp, Homo sapiens
  misc_feature: GZ8MTXP02ICQM6.13.11.A11.1.454.CMB.2.raw
  modified_base (373)..(373): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcctaccttgcgcagtggaccaccaagttgttcggtccctatgactatattagttggtaccacgagaacgccgagggactccctcccgtattcctcctggaggttcgagtacaactcaagaataaacgagaggctcgtcggacgtccccagcctccgttccgtcgtcggtacctaccgaaggtntcgtacgttcccgacccacgcgaaggtacttacttacgctactctcgtaggcctccgtatcgtagacgtagtggagtctagtacttacgtttagttgtttagtacgttcggaccaaactaacgaccgtcgtggtacttcggtaccggtaccgtacggaccgtcggttaccacgttccacggtccaacgtccccgaaacggccccctaacctcgtccgtactacccgttccgtacccgtcccccg

SEQ ID NO: 403760 - DNA, 590 bp, Homo sapiens
  misc_feature: GZ8MTXP02GK6MB.13.11.A11.1.454.CMB.2.raw
  modified_base (359)..(359): a, c, t, g, unknown or other
  modified_base (385)..(385): a, c, t, g, unknown or other
  modified_base (393)..(393): a, c, t, g, unknown or other
  modified_base (398)..(398): a, c, t, g, unknown or other
  modified_base (411)..(411): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaaccgacagaagccgagggactccctcccctagtttcctccgtgtacggttcaggtacaaactcaagataaacgacgaggctacgtggacgtccccagccgtcttctctggactaccgaagntgactccgacacgcgaggatactacncatctcgnggtcncgtagctgacgtntggacggtctacgtaacttatttacgttggtttacgtacgttacggactaaccgaaaccgtaacgtccgttaggacttccgtacgggtaccgtacgggaccctacggtccaccggtcgtacggtccaccgacccgaacggcccaacccacgtcgaacctccgttctacccgttaccccc

SEQ ID NO: 403761 - DNA, 568 bp, Homo sapiens
  misc_feature: GZ8MTXP02I3VZB.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggacgtcctccccagttctcctgaggttcaggtcaactcagataaacgacaggctcgtggacgtccccagccgtcttcctctggacctccgaaggatcgacttcccgacctacgccgagggattattactcatctcgtgggtcctcagtctgacgctgaggtctagacttattacgttgtttacgtactttcgactaacaaccgaacgcctaggaacttccgttacggacgttcggacctacggtacctacccggtactacggtcacgacccgaacggcccaacccgtactacgtaccactctaccgtttaccccc

SEQ ID NO: 403762 - DNA, 370 bp, Homo sapiens
  misc_feature: GZ8MTXP02JL50L.13.11.A11.1.454.CMB.2.raw
  modified_base (243)..(243): a, c, t, g, unknown or other
  modified_base (337)..(337): a, c, t, g, unknown or other
  modified_base (339)..(339): a, c, t, g, unknown or other
  modified_base (358)..(359): a, c, t, g, unknown or other
  modified_base (364)..(365): a, c, t, g, unknown or other
  modified_base (367)..(370): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaaacctgaagactttgctactttattcngtcaccagtatggtagtcaccgtacacgtttgccaggggaccaagctggagatcaagcaactgtgctgcaccatctgtctcatctcccgcatcngntagacgtgactgagcgggnngcagnnannnn

SEQ ID NO: 403763 - DNA, 521 bp, Homo sapiens
  misc_feature: GZ8MTXP02IK98D.13.11.A11.1.454.CMB.2.raw
  modified_base (329)..(329): a, c, t, g, unknown or other
  modified_base (422)..(422): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctaggaaataattggacagataaatatacttcctggtatcagcagaagtcaggccagtcccctgtgctggtcatctatcaagatgccaagcgccctgacgggctcccccgtgacncgtattctcgtcggctccaactcgtacgggaacctcagcccatctgacatcaggcggaccccaggctagtcgatgacggctagacttattacngtcgaggcgtagggacaggcagcactcgccgacttagcgtccgtacggaactacggggaacctaacggtccaccggtactaacggtccaagaacccccg

SEQ ID NO: 403764 - DNA, 752 bp, Homo sapiens
  misc_feature: GZ8MTXP02HVCSI.13.11.A11.1.454.CMB.2.raw
  modified_base (172)..(172): a, c, t, g, unknown or other
  modified_base (234)..(234): a, c, t, g, unknown or other
  modified_base (245)..(245): a, c, t, g, unknown or other
  modified_base (292)..(292): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctnagtcgtccgtcgtcccaggacagacagccagcatcactgctctagaatatggacagataatntactctagtancagacagagtcacggcctacgtcccctgtcgcgttggtacatactanacgaagtactcgaccaacggccggacctacggaggtacctccccgagacgcgtacttctccgtcgtcctacgaacgttcggtacggaaacctcgacgtaccctacgttaccacgtaccacgtaccggaaccgggacccgggtaacccgtaaggtaccgttaacgggtaggtaacgttacgggaccggttacgttaaaccggtttaaacgtttaacgtttaaccgggtacgggtttaacccgggaaacgggggtttccgggtaaacgggggaaacccttacggggaaacccgttaccggaacccgttaaccggttcccgggtaaccccgttacgtttaaacggtttcccggtttaaccgggtaaccggttaaaccgggttaccgggaaaacccgttaaacgggtaccccgttaaaacccggttaccgtaaaccggtacccgtaaaacccggtaacccccgg

SEQ ID NO: 403765 - DNA, 385 bp, Homo sapiens
  misc_feature: GZ8MTXP02FKQ90.13.11.A11.1.454.CMB.2.raw
  modified_base (381)..(385): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacactttggccaggggaccaagctggagatcaagcgaactgtggctgcaccatctgtcttccatcttcccgcatctgatagtacgtgactgagcgggctggcaaggcgacatagnnnnn

SEQ ID NO: 403766 - DNA, 616 bp, Homo sapiens
  misc_feature: GZ8MTXP02HDN95.13.11.A11.1.454.CMB.2.raw
  modified_base (193)..(193): a, c, t, g, unknown or other
  modified_base (388)..(388): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagcctacatcacctgctctggagatgtattgaactaacgagtatcggttcctggtactcagcgaagaaggcacggccacgtccccctgtccctactctattcttacaaaactccgacgggtccgtccctcggtcgggtccctgacgtcgtacttccgccccggtcctcccgtcctcgtacgggaacctacncgttcactcctacgaaccatccgacgaccgacccagtcctagtcgagtgacgtctacgtctacgttcgtcgtcgacggtcggtaggacgaacgaggcgtggtcgtacggtcgggacggacgggaccgacgtcgtacgtccggtacgtaggtaccgaccgacccgtaacggtcccgtcccgtcccccggtacggtcctaccgtttccgtcccgttcccccggtaccccc

SEQ ID NO: 403767 - DNA, 549 bp, Homo sapiens
  misc_feature: GZ8MTXP02FSFY4.13.11.A11.1.454.CMB.2.raw
  modified_base (243)..(243): a, c, t, g, unknown or other
  modified_base (410)..(410): a, c, t, g, unknown or other
  modified_base (528)..(528): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccagggacgtcctccccagttctcctgaggttcaggtcaaactcagaataaacgacaggctcgtggacgtccccagccgtcttctctggacctccgaaggatgactcccgacacgcagggatattactcatctctgggcctccgagtctagacgatgacggntagacttattactggtttcgacttggacctaacaaacgacgcctaggacttccgttacggaccgtgggaccctacggtcaccggtcctaagggtccacgcccaaggccccaaacccgntcgtcactcctcgttcccccg

SEQ ID NO: 403768 - DNA, 597 bp, Homo sapiens
  misc_feature: GZ8MTXP02FP1QB.13.11.A11.1.454.CMB.2.raw
  modified_base (217)..(217): a, c, t, g, unknown or other
  modified_base (300)..(300): a, c, t, g, unknown or other
  modified_base (552)..(552): a, c, t, g, unknown or other
  modified_base (581)..(581): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagacctccctggctgtgtctcgtgggcgaggagggcccaccatcaactgacaagaccagccagagttgtttanacagctccgacaagtaggaactacttagcttaggaaccaacgagaaaccaggacacgcctaccgtaaagttcctactttacgngggtcctccgtaacccgggatcccggggtcctaggaccgtattcgaggtcggcgaggcgggtcgtaggggactagtactttccactctaccacatacacgccacgtccttcgaggtctagaaatgtgtggacttaagtttatactgtacagtactaattatatactccgtactcctcgtcggtacgttcgaccgtagggacagggtacgaaactacgaaaacgtacgtggtcggacctgacctactacttcncgttccttcgtaccttccgtacccccgtntactacgtacgtaacg

SEQ ID NO: 403769 - DNA, 522 bp, Homo sapiens
  misc_feature: GZ8MTXP02H0BGU.13.11.A11.1.454.CMB.2.raw
  modified_base (387)..(387): a, c, t, g, unknown or other
tcagtcacgtactacacgaccggtgctcgatttagctacgactgcaggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggagtcctccccagtttctcctgaggttcaggtcaactcagataaacgacagggctctggagtccccagccgcttctctcggatccaaggatgattccgccaacgcagggatagtactcatctctggctcagtctnacgatgagctgactattactgtttgacttggcacaacaacgcctaggatacttcggaccctcgggacccgtacggtccgaaccgtcctaggtccacgccccgaaggccccaaacccgctcgtacacctctacccg

SEQ ID NO: 403770 - DNA, 448 bp, Homo sapiens
  misc_feature: GZ8MTXP02HUQRU.13.11.A11.1.454.CMB.2.raw
  modified_base (317)..(317): a, c, t, g, unknown or other
  modified_base (436)..(448): a, c, t, g, unknown or other
tcagtcacgtactacacgaccggtgctcgatttagctacgactgcagggccagtcagattgtcagcagcaactacttagcctggtaccagcagaagcctggccaggccccccaggcctcctcatctacgatgtattcaggagaccactgacatcccagacaggttcagtgcagtgggtctgggacagacttcactctcaccatcagcagactggaactgaagtactttgcttatttattctcgtcacctagtatggtaggtacacgtactactttggccaggggaccaagctgagatcaagcgaactggtacggtcngcaccattctgtcttccacgttccctttcccccgactattccgtagtacgttacgggtactacgtaccgttaggggacggtccgggtcctaggggaccaaagggggcacggtattagcnnnnnnnnnnnnn

SEQ ID NO: 403771 - DNA, 402 bp, Homo sapiens
  misc_feature: GZ8MTXP02GP21A.13.11.A11.1.454.CMB.2.raw
  modified_base (394)..(402): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggagaccactgacatcccagacaggttcagtggcagtgggtctgggacagacttcactctcaccatcagcagactggaacctgaagtctttgctacttttattctgtcaccagtatggtagtcaccgtactactttggccaggggaccaagctggagatcaagcgaactgtgctgcaccatctgtcttccatccttcccgcctatcctgacttacgtacgtgactggagcggggtctgggcaaagggcgacagtagnnnnnnnnn

SEQ ID NO: 403772 - DNA, 710 bp, Homo sapiens
  misc_feature: GZ8MTXP02GJIEE.13.11.A11.1.454.CMB.2.raw
  modified_base (245)..(245): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccganagaagcaggactcctccctagttctcctgaggttcaggtacaaactcaagaataaacgacgagggctacgtcggacgtccccgagccgtcttctcgtggacctaccgaaggtatcgtacttcccgacaccggcgaacggggattacgttactacactttccgtcgtcgggtccctaccgtaacgttcgtaggaaccggtagttacgggacggtacgtacggttaacctttaagttttaccgttaggtttttacggtaacgtttacgggaccctaaaccgtaaaaccggtaaaccgttacccggttagggtaacctttccggtttaacccggggtacccgttacggggaaccccgtacgggttcccgaccccggttaccggtacggttacccgaccgaaccccgaaacgggaaccccctaaacccgtacgttacgtacctaccgttccgttacccgtttccccccg

SEQ ID NO: 403773 - DNA, 419 bp, Homo sapiens
  misc_feature: GZ8MTXP02HJGFF.13.11.A11.1.454.CMB.2.raw
  modified_base (409)..(419): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgctacttttattctgtcacagtatggtagtcaccgtactacgtttggaccgaggggaccaaggcgtggagatacgaagacgtaactggtacggctcgacacctatctcgtcttccacttccttcccgctatctgacttacgtacgtgactgacggccgggctggacaaggcgacgagtagnnnnnnnnnnn

SEQ ID NO: 403774 - DNA, 779 bp, Homo sapiens
  misc_feature: GZ8MTXP02GH9G0.13.11.A11.1.454.CMB.2.raw
  modified_base (200)..(200): a, c, t, g, unknown or other
  modified_base (242)..(242): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcncagtggcaccaatgttcggtcctatgacatatattggaccanagagcgaggacgtcctcccagtttctccgtagaggttcaggtacaaactcaagaataaacgacgagggctcgtaggacgtcccgagccgtctctcgtacggactaccgaaggtactcgtaacttcccgaccgtaaaccggcgtaaagggggtacttaacgttaaccgtactaacttcgtcggttcggggtaccttaccgtaggttacccgttacggaaccgttacggtacgggtaagggtaccgttaacgttaaaccggtttaacttttacccggtttagggtttttaccgtaaccggttttacggggaaccctaaaacccgtaaaaccggtaaacccgtcccgggtttaagggtaaccgtttaccggtttaccggggaaaccccggttacgggggtaaaaccccggtaccgggttaaccccggtaacccggttacccggtaaccgggttacccgaacccggttaaccccggaaaaccgggtaccccctaaaccccgtacgttaccggtaaccttacctttcccggttttacccccg

SEQ ID NO: 403775 - DNA, 652 bp, Homo sapiens
  misc_feature: GZ8MTXP02HUTKF.13.11.A11.1.454.CMB.2.raw
  modified_base (215)..(215): a, c, t, g, unknown or other
  modified_base (226)..(226): a, c, t, g, unknown or other
  modified_base (290)..(290): a, c, t, g, unknown or other
  modified_base (409)..(409): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaaactgacaagaccagccagagttgttttanacagctccganaataggaactacttagcttggaaccaacagaaaccaggacagcctccgaaagttctctttacgngggcctcgtacccgggatcccggggtcctaggaccgattcgagtggcaggtcgggtctggggactagtactttcactctacactatcagctacgtccttacgaagggtctagtaaacgngttggtacgtacttagtttacttacgtagtacgtaagtactaaatttacgttacttaccttccttaccttacccgttacccgtacgggttaccggttaccggaaccggtaaacggggtaccggtaagggtaacgtaaactaaccgaaaacgtacggttgtacggtactacgactaaccgtacttccgttacgttacctaaccgtacgtttcccttaccccgacttacgtaccgttacgtaacg

SEQ ID NO: 403776 - DNA, 643 bp, Homo sapiens
  misc_feature: GZ8MTXP02I8GWM.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccgacagaagccagggacgtccctccccagttctcctgacggttcacggtcaaactcaagaactaaacgacgaggcctcgtaggaccgtccccgagcccgtctttcctcgtacggacttacccgaaaggtctacgtacgttccccgacccacggccgaagggattaacttacctactattccgttcgtcgggacctcccggtatctacggaagacgtaggacgtctacgtacttagttacgttagttacgtacgttacgacctaaccgaaaccgacgtcgtagtacttccggtacggaccggtacggaacccgtccggtaccgtaccggtaccgtacggtaccgaaccgacccgaaccgaaccccaacccgtacgtaccgtacctaccgttccgttaccctccccg

SEQ ID NO: 403777 - DNA, 631 bp, Homo sapiens
  misc_feature: GZ8MTXP02IVVT6.13.11.A11.1.454.CMB.2.raw
  modified_base (243)..(243): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccagggagtcctcccctagttctcctgaggttcaggtacaaactcagataaacgacaggctctggacgtccccagccgcttctctggactccgaagatgattcccgaccacgcagggatacgttactcatctcgtgggcctccgagtctagacgtatggacggtctagaacttagtttaaccttggttttacgtactttcgggacaacctaaaccgaaccgtccgttaggaacttccgttaccgggaccgtacggggaacccgtacgggtaccgtacccggtaccgttacgggttccgaaccgccccgaaaaccggggtaacccccaaaacccccgtacgttaccggtacctaacccgtttaccttacccggtttcccccccg

SEQ ID NO: 403778 - DNA, 666 bp, Homo sapiens
  misc_feature: GZ8MTXP02IAQ6A.13.11.A11.1.454.CMB.2.raw
  modified_base (200)..(200): a, c, t, g, unknown or other
  modified_base (281)..(281): a, c, t, g, unknown or other
  modified_base (378)..(378): a, c, t, g, unknown or other
  modified_base (417)..(417): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcncagtgcaccaatgttcggtcctatgactattatagttcggtaaccgacaagtaacgccgagggactccctccctagttccnctggtagttcagtaccaaactcaagtaaacgtaaacgacgagggtctcgtacggaccgtccccgagcccgtcttctcgtaggtaccctaccgaaggntacgacttcccgacacgcgaggtacttacttacgtactnttccgtcgttcggcccttaccgagtccgagtaccgagtggtaacggtcttagtactttaaacgttgtttcggtttcgtaacgttcggaacctaaaaccgaaaccccgtaaggtcccgtagggtaactttccggttaacccggtaccggtacccggtaacccgtacgggtaaccctccggttaccgtacgggacccacggacccaaacggtcccccaaaaccgcttacacctccttccgtcccgtccccc

SEQ ID NO: 403779 - DNA, 690 bp, Homo sapiens
  misc_feature: GZ8MTXP02JQBS5.13.11.A11.1.454.CMB.2.raw
  modified_base (306)..(306): a, c, t, g, unknown or other
  modified_base (330)..(330): a, c, t, g, unknown or other
  modified_base (352)..(352): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttcctccgtggagcgtcagccagtctcacctgcaccttgcgcagtgcaccattgttcggtccctatgacattatagttcggaccgacagaacgccgagggactccctccctagtttcctccgtgtacggttcacggtacaaacgtnaagtaactaaacgacgaggctcgnggaccgtcccagccgtacttcncgtggacctaccgaagtctacgtacttacccgaccacggcgtaaggggtaacttaacttaccgtacgtacgttccgttaccgtacggggtcccttaccgaacggttctacggtaccgtaagtcgggaacggttctaacgggtaactttagttaacgttgtttacgacgtttacgacgtaaaccaacgtaaccgtcgtgggttaactccgttaaccgggcgtaccggaccgaccggttccaccggttactacggtacccgaacggtacccccgaaaccggaaccccctaaaccccgtacggttcctaaccgtccgttacccgtttacggttcccccccg

SEQ ID NO: 403780 - DNA, 618 bp, Homo sapiens
  misc_feature: GZ8MTXP02IMYPO.13.11.A11.1.454.CMB.2.raw
  modified_base (269)..(269): a, c, t, g, unknown or other
  modified_base (340)..(340): a, c, t, g, unknown or other
  modified_base (356)..(356): a, c, t, g, unknown or other
  modified_base (413)..(413): a, c, t, g, unknown or other
  modified_base (536)..(536): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccgacagaagccagggatcctcccctagtttcncctgtaggttcaggtaccaaactcaagaactaaacgacgagggctcgtggacgtccccagcccgtcttccncgtggactccaaaggntagacttcccgaccacgcgagggtattacttactcgattctcgtggtcctccagtcngactgtacgaggtcgtagtacttaattacgttgtttacgacgtttacgggactaaacccgaaacgtaaccgtccgttaggtaactcgtttaccgggaaccgtcgggaaccctacggggtaccncccggttactacgggtccaacgacccgaaccggtaacccgaaaccccctagaccgtcgaaccttccgtcccggtttcccccg

SEQ ID NO: 403781 - DNA, 659 bp, Homo sapiens
  misc_feature: GZ8MTXP02H74TP.13.11.A11.1.454.CMB.2.raw
  modified_base (179)..(179): a, c, t, g, unknown or other
  modified_base (203)..(203): a, c, t, g, unknown or other
  modified_base (223)..(223): a, c, t, g, unknown or other
  modified_base (238)..(238): a, c, t, g, unknown or other
  modified_base (314)..(314): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctnagccgtctcggggacccccggagngtgtcaccatctcttgttcnggagcagtgcccaanagtcggggataatatgctatctgtatcaacactcccgaggaaccgccccagactcctcatcatagccaataacccngaccggcccctagacggggtcccctggaccccgtattcctcgtcgctccgaagtcgtacgcctaaccttcgacgtcccttaccgcgggacccctaagtccgaacggttcggggcccttacccgggtccgaccggaagttcggaacgggtcctagtaatttacttaacgtcgtttacgaggttccgtttaggggacttacggaactcgtcctaggttaaatttcggtttcggggttttacggacggggtacggtaacccgttaaaagttccggacccgtaccggttaacggtcgaaaccgcccccggtaaaggcccgttccgccccccgttcggtaaccctacccg

SEQ ID NO: 403782 - DNA, 810 bp, Homo sapiens
  misc_feature: GZ8MTXP02GQM60.13.11.A11.1.454.CMB.2.raw
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgccaccttgcgcagtgcaccatgttgtcctatgacatatagttggaccgacagaagcagggactcctcccagtttctcctggacggttcaggtaccaaactcaagtaacgtaaacgacgaaggggtctcgtagggtacgtcccccgaggcccgtcttcctccgtacgggtacctaccgtaaaggggtcttacggtaaccgttccccggaccgtaaaccggtacggtaaacggggtaactttaaccgtttacctacgtaaccgttcccgtcggttcgggtcccttacggtagttcccgtagggtaaccgtagttacgggaggttccctaaggttaaacctttagtttaaccgtttgggttttaccgtaacggtttaccgggaaccctaaaaccgtaaacccggtaacgttcccgttaaacgggtacctttaccgggtaccgggtaacccggggtttaccggggaaccccgttaaacccggggtccgttaaacccccgggttaccggtttaaccggggaccctaaccccgggtaaacccccggaacccgggttaaaccccccctaaaccccgttacgttacccggtaaccctttaaccccgtttaccggttttccccccccg

SEQ ID NO: 403783 - DNA, 360 bp, Homo sapiens
  misc_feature: GZ8MTXP02IF87B.13.11.A11.1.454.CMB.2.raw
  modified_base (296)..(296): a, c, t, g, unknown or other
  modified_base (346)..(346): a, c, t, g, unknown or other
  modified_base (350)..(350): a, c, t, g, unknown or other
  modified_base (352)..(360): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcagaaggacactgacatcccagacaggttcagtggcagtgggtctgggacagacttcactctcaccatcagcagactggaacctgaagtacttttgacttactttatttctgtacactagtatgaactgtgctgcacatctgtctttcagttccttccccnctactctagtattacggtacgttgactgacggcgggctgggacaaggcgntaanannnnnnnnn

SEQ ID NO: 403784 - DNA, 581 bp, Homo sapiens
  misc_feature: GZ8MTXP02FX59O.13.11.A11.1.454.CMB.2.raw
  modified_base (251)..(251): a, c, t, g, unknown or other
  modified_base (284)..(284): a, c, t, g, unknown or other
  modified_base (368)..(368): a, c, t, g, unknown or other
  modified_base (384)..(384): a, c, t, g, unknown or other
  modified_base (397)..(397): a, c, t, g, unknown or other
  modified_base (426)..(426): a, c, t, g, unknown or other
  modified_base (526)..(526): a, c, t, g, unknown or other
  modified_base (560)..(560): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacctaattgttcggtaccctatgactatatagttggtaacccganaggaagccgagggacgtccctccctagtttccncctggtacgttcaggtacaaactcaagaagtaaacgagaggctcgacggacgtccccagcctctctcgtggacctaccgaaggntacgtactccgcacgngaaggtatactcnctatctcgtggtactcgagtcgtgaacgngtacggagtctacgtatttaacgttacgttgtttacgacttacgggtacaaactaaccgtaccgtctaggtactcgttccggacgtcggaccgtcgtacnccgtacaggtccacgtaccaacgccctaaaccgntacgctacctctccgtacccc

SEQ ID NO: 403785 - DNA, 738 bp, Homo sapiens
  misc_feature: GZ8MTXP02H4TPM.13.11.A11.1.454.CMB.2.raw
tcagtcacgtactacacgaccggtgctcgatttagctacgactgcagggggggaagagctgctcagttaggacccagagggaaccatggaaaccccagcgcagcttctcttcctcctgctactctggctcccagataccaccggagaaattgtgttgacgcagtctccaggcatcgtgtctttgtctcgaggggaaagacgccaccctctcctgcacgggccagtcagattgtcagcagctaaactacttagcctaggtaccagcagacgcgtcggccacggcccccaggcctcctcatcctacgattcgtatcgaggacgaccagtcgacactccgagacgaggttcagtcggacgaggtcgggtcgtagggactacggtccttcgactcctaccgaccacgtaccagacccagaccgttaacggaaccgtaggtaaacgtttacgtttacgtacctttaacgttttactttccgtaacgttcccgtaaaaccgttaggtttaaacgggtttacgggtaaccggtttacccgtaacccgggttttacttaaaccgggttttccgggaacccgggttaaaccggggtacccggtaaagggtcccgtaagggggttaaaactaaaaccggttacggaaaccgttaccgggtaacgttacgggtaccggtaccgtaccggtaaccgtaaccgttacgtttaccgttacgtttaacccgttacccgtttacccgtaccccg

SEQ ID NO: 403786 - DNA, 672 bp, Homo sapiens
  misc_feature: GZ8MTXP02I7PME.13.11.A11.1.454.CMB.2.raw
  modified_base (517)..(517): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcgtgggttttccttgttgcttattttaaaaggtgtccagtgtgaggtgcagctggtagagtcgtgggggaggtggtggtacggccgtgggggtccctcgagactctcctgtgcaacctctggtattcagtattgagtgagtatggacatacacgtcgggtcccaccaaaccgtccgaaggggaacgggctggccgtagggtggtctcgttagtaataaaacggtggtaacgtggtacgacgaagacaaactaacttagtcgacagtacctcgtaggtacgggaaacgggcctaacttaccaaccctattcccaccgaaagtacgaactaggtcgacccgaaagtaaccccgtaccgtaagtaactcgtanaaaccgtaaaagtcgaaactaacggtcgtacgggtaacggtacggaacgtaacccggtccggttccgttttagttactttcggtaggtcggtacggttaggttaagcggtaaggttccggtacgttaccgggtaaacttacggacttaaacgggg

SEQ ID NO: 403787 - DNA, 642 bp, Homo sapiens
  misc_feature: GZ8MTXP02HCI4W.13.11.A11.1.454.CMB.2.raw
  modified_base (605)..(605): a, c, t, g, unknown or other
tcagtcacgtactacacgaccggtgctcgatttagctacgactgcgggggtaagaggttgcgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtcggcccaatgttcggtccctatgacatatagttggaccgacagaagccgagggacgtccctccctagttcctccgtgaggttcaggtacaaactcaagaagtaaacgacgagggtctcgtggacgtccccagtccgtcttctcgtggactaccccgaaggactcgtaacttcccggaccaaacggccgaaggggtaacttaacgttaacctctaacttccgttcgtacggggtcctacccgtagttccgtaggaccgtaagtggaacgtcgttagaactttattaacgttgtttcgacgtttggactaacgaacaacgcctaggacttcgttaccgaccgtcgggacctaccgggtacctaccgtccgtagggaccacgaccccgaacgaccccaaaacccncgtaccgtccaaccgtctacccgtttaccccaccccg

SEQ ID NO: 403788 - DNA, 439 bp, Homo sapiens
  misc_feature: GZ8MTXP02FSHQC.13.11.A11.1.454.CMB.2.raw
  modified_base (407)..(439): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttattctgtcacagtatggtagtcaccgtacactttggaccagggaccaagctaggagatcaagcgaactgtggctgccaccatctgtcttccactccttacccgcctatcctgtagtacgtacgtgacgtgaacgcggggtctacgggacgtaaaggccgactagtagnnnnnnnnnnnnnnnnnnnnnnnnnnnnnnnnn

SEQ ID NO: 403789 - DNA, 586 bp, Homo sapiens
  misc_feature: GZ8MTXP02FXXKG.13.11.A11.1.454.CMB.2.raw
  modified_base (242)..(242): a, c, t, g, unknown or other
  modified_base (319)..(319): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccanagaacgccgagggacgtccctccccagtttcctcctggtacggttcaggtacaactcagaataacgacaggctacgngacgtccccaggccgtcttctctggacctaccgaaggtatagtacttcccggacctacgcgaaggtactacttacgactactctcgtacggcctaccgagtccagtacgatgaggctagacttatactggtttacagttcgacactaaaccgctacggtgtactcgtacggaccgtcggtaacgccgttacaccggtaccgttcggacctacgacccgtaacggcccctaaacccgtctcgtacctacctaccgtcttaaccccccg

SEQ ID NO: 403790 - DNA, 790 bp, Homo sapiens
  misc_feature: GZ8MTXP02IBAIJ.13.11.A11.1.454.CMB.2.raw
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactactagcttggtaccaacagaaaccaggacagcctaccgagttactctttactgggccgtctacccggaatccggggtccctgaccgattcagtggcagcgggtctggggactagactttcactctcaccatcagcagccctttacgaggctaggaaagtacgttgtcggggtacctaagggtttttaactttaccgtaggttacctaaagggtaccttaaaaactttatttaaacttaaacgtttacccgtttcctttaaccccccgttttcccccgttacccgggggtttacccgtttttacccccgggggtaaaacccccaaaaccggggggttaacccccgtaaagggggggtttaaaccggggtaaaaactttaaacccggaaaaaacccgggttaaaacccgttggggttaaaccggggtaccctacggggtaccccctaaaacccccgttgttaaacccccgtttaggggtttccccttttaacccgtaattttcccccccgttttcccccggggacccccttaatttaccccggttacgggtttaaaacg

SEQ ID NO: 403791 - DNA, 661 bp, Homo sapiens
  misc_feature: GZ8MTXP02GZGDA.13.11.A11.1.454.CMB.2.raw
  modified_base (224)..(224): a, c, t, g, unknown or other
  modified_base (245)..(245): a, c, t, g, unknown or other
  modified_base (353)..(353): a, c, t, g, unknown or other
  modified_base (631)..(631): a, c, t, g, unknown or other
  modified_base (640)..(640): a, c, t, g, unknown or other
  modified_base (659)..(659): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccgtggagcgtcagccagtcctcacctgcacttgcgcagtgcactaatggttcgtcctangactatatagttcggaccganaagagccgaggacctccctaccctagttcctcgtaggtagtcgaagtaccaacgtacaagtaacgtaaacgacgaggtctacgtacggaccgtccccagtcctcttcncgtacggacaccgaagtatcgtaacgtcccggacctacgggcgaaggtacttacttacctactacgtttcgcgttcggaccttacgacgtacgtagtaaacgcggtacggaccggtaaccttaactttacgtttaaccgtttggtttaacgtaaccgttcggaacctaaccgaaacgaaacccggttcgtacgttccgttccggtaaccgggtacgtacggaaccgtcgtacccgtacgacctggaccaccgtaacccgacgtaccccaaaccgtccncgttacccnccgttcgtccccgtacccncg

SEQ ID NO: 403792 - DNA, 577 bp, Homo sapiens
  misc_feature: GZ8MTXP02J4V0C.13.11.A11.1.454.CMB.2.raw
  modified_base (347)..(347): a, c, t, g, unknown or other
  modified_base (432)..(432): a, c, t, g, unknown or other
  modified_base (446)..(446): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctgggagcgtcagccagtctcacctgcaccttgcgcagtggcaccaatgttggtccctatgacatatattggtaccgacagaagccagggacgtccctccccagtttctcctgaggttcaggtcaaactcagataacgacaggctctggacgtccccagccgcttctactggactccaaggntgacttcccgcacgcaggggatattactcatctctgggctcagtctgacgatgaggctgactattattcgttgttacttcggacnccaacaacgtaccncggtaacgggtcttccgggtaaccgtcgggtaccggaccggtaccgtaccgtttacccgacggttaccgtacggcccaaacccggaacccgaccctaacccctacgtactcctacccggttctttccccgg

SEQ ID NO: 403793 - DNA, 611 bp, Homo sapiens
  misc_feature: GZ8MTXP02GRDC3.13.11.A11.1.454.CMB.2.raw
  modified_base (243)..(243): a, c, t, g, unknown or other
  modified_base (277)..(277): a, c, t, g, unknown or other
  modified_base (323)..(323): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggacgtccctccccgtagtttccncctggacggttcacggtacaaacgtcagaataaacgcagggctcgnggacgtccccagccgtctctcgtggactccgaaggatgacttcccggacacggcaaggggtatacgttactacatcttcgtaggcccttaccgagttccgtaggaacccgtaagttcggaacggtccgtactaaacgtttacgttacgtttagtacgtacggttacaaccgtaaacaaaccgtacgtcgtacgttacgtcggtaccgtacggacgtaccgacgtaccgtaccgtacgtacgacgaccgaacgacccgaaccctacgacgtacactctcgtccctaccc

SEQ ID NO: 403794 - DNA, 588 bp, Homo sapiens
  misc_feature: GZ8MTXP02JN4IA.13.11.A11.1.454.CMB.2.raw
  modified_base (218)..(218): a, c, t, g, unknown or other
  modified_base (230)..(230): a, c, t, g, unknown or other
  modified_base (398)..(398): a, c, t, g, unknown or other
  modified_base (465)..(465): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagacctccctggctgtgtctcgtgggcgagacgggccaccatcaactgacaacgaccagccagagttgttttanacagctccgaanaataggaacttacttagcttacggtaaccaacgaagaaaccgaggacacgcctacgtaagttacttctttacgtgggtccgtacgtacccgggaagtcccggggtacctggaccgtattcgaggtcggcaggtccgggtcgtggacagtaccttccactcacacatcncgcagtcccttagaggtctaggaacgagtgtaggtctagtttattactgtacagtactaatattatntactctccgtcgtacggtacgtcgacgacggaccgagggtacgaactacgaaaacgagtcgtagctacgacacgtactcgtacgttctaactacttcccgtcccgtactcttaccgattaacg

SEQ ID NO: 403795 - DNA, 662 bp, Homo sapiens
  misc_feature: GZ8MTXP02FQA0E.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccgacaagaacgccgagggacgtccctcccctagtttcctccgtggtaggttacaggtaccaaactcaagtaactaaaacggacgacggggctcgtacggaccgtccccgacggtcccgtccttctcgtaggacctaccgaaaggatgtacttcccgaccacgcgagggtacttacttactctactctcgtcggcctcgagtcgtagacgagtggacgtctacgtacttagtttacgtgtttcgtacgttcgacctaacgtaaaccaacgttccgtaggtactaccggttacggaccggttacgggaacccgtacgggttacccgtacccggttaccggtacggtaccgaacccggaaccccgaaccggaacccccaaaaccccgtcttacgtacctacccttcgttccccgttaaccccccg

SEQ ID NO: 403796 - DNA, 752 bp, Homo sapiens
  misc_feature: GZ8MTXP02JTCSG.13.11.A11.1.454.CMB.2.raw
  modified_base (192)..(192): a, c, t, g, unknown or other
  modified_base (219)..(219): a, c, t, g, unknown or other
  modified_base (283)..(283): a, c, t, g, unknown or other
  modified_base (381)..(381): a, c, t, g, unknown or other
tcagtcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctctgganatgtattgactacgagtatggttctggtatcagcagaaggcaggcccacgccccctgtccctanctacttctttacaaaactccgaggtccgccctcggtcggggtcccttggacgtcgtacttccgcccccggtctcccgtcctacggttacgggaaaccncgtacgttccaacttccgtaccggaacctacgtccgaacggggccccgggaacccctaaggtacccgtttagtttacggaaagtttcgggaaccggttctttacgggttacctttaccgtttcgttaccgggttaccggtacgggggttacccggttaacgggggaaaccctaaacgggtacgggttcccggttagggtacccgtttcgggggttacccggggacgggggtaaccggggtaacccgtcgggttaccgtaccgggtacccgttacggttaccgggtacccgaccgaaccccggtacggacccgttcccggtcccccgtacgggtccctaacccgtttccgttcccggttaccccctcccccg

SEQ ID NO: 403797 - DNA, 700 bp, Homo sapiens
  misc_feature: GZ8MTXP02IJ4WI.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgccttctcctggagcgtcagccagtcctcacctgcaccttgcgcagtcggcaccaattgttcggtcctatgactattattattcgggtaacccgacaagaacgccgagggacgtccctcccctagtttctcctggtacgttcaggtacaaactcgaagtaactaaacgacgtagggctacgtggaccgtccccagccgtccttccgtatcggactaccgaaggtactcgacgttcccgacctaacggccgtaaaggggtaacttaactttacctcgtaacttcgttccgttcgggccctttaccgagttcgtaggacgtagttaggacgttcgtacgtactttaacgtttaccgtttaggttttacgtacgttaccggaactaaaccgtaaaccgaacgttcgttaggtacgttccggtttaccgggacgtaccggggacccgtaaccggtcctaacccgggttacgacggtaccgacccgacccgaaaccggccccaaccccgtacttacggacccttaccgttccgtaccgtttcccccc

SEQ ID NO: 403798 - DNA, 412 bp, Homo sapiens
  misc_feature: GZ8MTXP02JGHF0.13.11.A11.1.454.CMB.2.raw
  modified_base (402)..(412): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcaggtgggtctgggacagacttcactctcaccatcagcagactaggaacctgaaagtctttgcttacttttattctgtcaccagtatggtaggtcaccgtctacgtttggaccgaggggaccaagctaggagatacaagcgaaactgtgctcgcacatctagtctccactcctcccgcagtctagtatatacgtagacctgacgcgggcgtggaccgaggcgacaagtagnnnnnnnnnnn

SEQ ID NO: 403799 - DNA, 566 bp, Homo sapiens
  misc_feature: GZ8MTXP02FWPON.13.11.A11.1.454.CMB.2.raw
  modified_base (300)..(300): a, c, t, g, unknown or other
  modified_base (309)..(309): a, c, t, g, unknown or other
  modified_base (347)..(347): a, c, t, g, unknown or other
  modified_base (381)..(381): a, c, t, g, unknown or other
  modified_base (426)..(426): a, c, t, g, unknown or other
  modified_base (501)..(501): a, c, t, g, unknown or other
tcagtcacgtactacacgaccggtgctcgatttagctacgactgcgggggtaagaggttgtgtccaccatggcctggactcctttcctcctcctgctcctctctcactgcacaggttccctctcgcaggctgtgctgactcagccgtcttccctctctgcttctcctggagcgtcagccagtctcacctgcacttgcgcagtgcaccaatgttgtcctatgacatatattggtaccgacagaagccagggagtccctcccagtttctcctgtagttcaggtcaaactcaagataaacganagggctcgnggacgccccagccgtccttctcgtaggactcccgaagntagacttaccgaccacgcgagggtatatttaacnctaagtctacgttcgggctccgagtctggacgatggacgcgttanacgttattacgtgttagacgttgactaacgaacgaccgtcgtacgtactcggtacgacgtacgaccgtacggtcnccgtacgtacgtacaccgacccgaacgacccaacccgtacgtctactcctcgtcccgtccctccg

SEQ ID NO: 403800 - DNA, 712 bp, Homo sapiens
  misc_feature: GZ8MTXP02ILWAN.13.11.A11.1.454.CMB.2.raw
  modified_base (170)..(170): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggngcgtcagccagtcctcacctgcaccttgcgcagtggccaccaattgttggtcctatgacatatattggtaccacagaagccagggacgtcctcccagtttctcctgaggttcaggtcaaactcagaataacgacgaggctcgtcggactccccagcccgtcttcctcgtggactacccgaaaggtactgtactttccccggccaacggccgaaggggtacttacgtttacctacaattcccgttacgtggggtcccttcccgaaggttcctacgggtacgacgttggaaacggtcgttacggtaactttagtttaaccgttttgggttttacgtacggtttcgggtacccaaaccgtaaacccgtaaccgtaccccggtttaggtaacgtttcccgtttaccgggacccgttaccggggacccgtaaccgggtccgtaacccgttacccgtacgggtaccgaacggacccccgtaaacggaaccccgaaacccccgtacgttaccggtacctaacccgttccgtttacccggtttccccccc

SEQ ID NO: 403801 - DNA, 714 bp, Homo sapiens
  misc_feature: GZ8MTXP02JEKUV.13.11.A11.1.454.CMB.2.raw
  modified_base (201)..(201): a, c, t, g, unknown or other
tcagtcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcgggacccccggnagagtgtcaccatctcttgttctggaggcagtcgccaacagtcgggaataattatgcattctggtatcaacaacctcccaaggaaccgcccccagacctccccatctatagcaataaccacgccggccctacgacggggtccctgaccgactttcctcgtcgtctaccgtaagtccgtcgggccaaacccttcaacgccccgttcccgtggcccaacttcgaacggtcggggtcccgtcccggggttacccgaaccggtagtcggtaacgggtcctaggttaaacttttaacgtttaccgtttacggtttacccgtaagtccgttttagggggaactttcggggaacctagggtacccgttggtaaaaccgtttcggttttacggggtttccggggacgggtacgggtaaccgtaaacggtttccggaaacccgtccggttaccgggtccgaaacggtccccgtaaacgggtccctacccggtcccccgttcgggtaccctaacgtttccccg

SEQ ID NO: 403802 - DNA, 744 bp, Homo sapiens
  misc_feature: GZ8MTXP02HCQQP.13.11.A11.1.454.CMB.2.raw
  modified_base (218)..(218): a, c, t, g, unknown or other
  modified_base (231)..(231): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctcgtgggcgaggacgggccaccatcaactgacaagaccagccagtagttgttttanacagctaccgaanaataggaactacttagcttaggaaccaacgaacgaaaccaggacacgccctacgtaagttaccttacgttttacgcgggaccgttaccgtaaccccggggtacgttccccggggtccctacggacccgtattcgaggtcggaccagggtcgggtacgtgggaactaggtacctttcgacttccacaccagtcacggctaacgtcccgttacgagggtctaggaaagtagttggtacggtacttaacggtttattaccgtagtaccgaagtacttaaattattattactccgttaccttcccttaccgttaccggttaaccgtttacccgggaaccgtaaacgggggtaaccggtaagggggttaaacgaaaacgttaaccgtaaaaccgggtaaccgttagggtaccgggtaacttaccggacccgttaaacctaacgttaccgtttccgttaccttaacccgttaacttcccccgttaccccggtaactctttacccggttaagttaaccgg

SEQ ID NO: 403803 - DNA, 627 bp, Homo sapiens
  misc_feature: GZ8MTXP02FKZ9A.13.11.A11.1.454.CMB.2.raw
  modified_base (293)..(293): a, c, t, g, unknown or other
  modified_base (331)..(331): a, c, t, g, unknown or other
tcagtcacgtactacacgaccggtgctcgatttagctacgactgcaggcaggggcagcaagatggtgttgcagacccaggtcttcatttctctgttgctctggatctctggtgcctacggggacatcgtgataagtcagtctccagactccctggctgtgtctcgtgggcgagagggccaccatcaactgcaagaccagccagagtgttttatacagctccgacaataggaactactagcttaggaaccaacagaaaccaggacacgcctaccgtaagttacttcttttacgnggcgtccgtaacccgggacgtccggggtccctgaccgnttcgaggtggcgaggtcgggtcgtgggacagtaccgtttcactctacacctatcagcctaggtcccttacgacggtctaggaaagtacgtgtggtactaagttttatacttgtaccgtagtaactaattacttatacttcccttaccttccgttcccgtacgggtaccgttaccgaacccgtaaggaccggtaggttaacggaaattaccgaaaacgttaacgtaggttcggacgtacgaccaacgtacttcgtacgttccttctacttcccgttccctacacttccgtagtaacg

SEQ ID NO: 403804 - DNA, 691 bp, Homo sapiens
  misc_feature: GZ8MTXP02HE40H.13.11.A11.1.454.CMB.2.raw
  modified_base (225)..(225): a, c, t, g, unknown or other
tcagtcacgtactacacgaccggtgctcgatttagctacgactgcagggggctgggcctcaggaggcagcatcggaggtgcctcagccatggcatggatccctctcttcctcggcgtccttgcttactgcacagaatccatggcctcctaatgagttgactcacgccaccctcatcgtccgtcgtcccccggacagacacgcctacactcacctgctcgtggatntgtattagaactaacgtagttacgtcggttcctggtatcgagacaaggaacggcacggcccaccgtcccccgtgtaccctactctacttactttaacaaactaccgacggtccgtcccgttcggtccgggttcctggacgtcgtacgttccgcccccggcctcccgaccgtcggtacggaactacgtgtccacttaccagtaacccagtccggaacggacccgggaccctacgtaccttacgttagacgtggacgtcgttacgttacttacgttcgtcgggtacgtacgggtacggtacggaacgaacggtgtccggtaggtccggtaggggttcgggacgggtacggtacgtacggttacgtacggttaccgttacggtacggtaccaccgggtacccgtacggtccctcccgggtccctaccggttacctacccgtcccggttacccgttccccgtttaccccg

SEQ ID NO: 403805 - DNA, 659 bp, Homo sapiens
  misc_feature: GZ8MTXP02H0HRE.13.11.A11.1.454.CMB.2.raw
  modified_base (249)..(249): a, c, t, g, unknown or other
  modified_base (630)..(630): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaattgttcgtccctatgactatattagttcggtaaccganaaggacgccgaggggactccctacccctagtttcctcctggtacggttcaggtaccaaactcagaactaaacgacgagggctcgtaggacccgtccccaggccccgtactttccgtcgtggtaacctacccgaaaggtactcgtacgttcccgaccctacggcgtaaagggtaacttaacttacctactacgttccgtcgtacgggccttccgagttccagacgtagtggacgtctagtaccgttatttaccggttgttcgttactggtacccactaaaccgacgtccgtagtaccgttcgttaccggtaccgtacgggtacccgtacgggtccaaccgttccgacggtccgaccgtacccgaacggaaccccaaccccgnttccgacctaccgttcgtaccttaccccc

SEQ ID NO: 403806 - DNA, 672 bp, Homo sapiens
  misc_feature: GZ8MTXP02JUBKO.13.11.A11.1.454.CMB.2.raw
  modified_base (246)..(246): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgactatatagttcggtaccganagaacgccgaagggacgtccctcccctagtttcctccgtggtacggttcaggtaccaaactcaagtaaactaaacgacgaggggtctcgtggaaccgtccccaggcccgtctttcctcgtggaacctaccgaaggtactacgtacttcccgacacgcgaagggtacttagtacctcacttctcgtcgggaccttccgagttactgaacgtagtaggacggcttaggtaactttaagtttaccgttaggtttacgacgttaggaccaaacgaaaccgaccggtccgtaggacttaccgttaccgggaccgttacggggaacctaccggttaccaaccggttaccgtacggtaccgaacgaacccccgaaacggaaccccaaaccccgtcgtttaccgacctacccgtttcctacccggtttcccccg

SEQ ID NO: 403807 - DNA, 707 bp, Homo sapiens
  misc_feature: GZ8MTXP02HLMRC.13.11.A11.1.454.CMB.2.raw
  modified_base (218)..(218): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgttgcctangacatatagttggaccacagaacgccagggactccctccctagtttcctctgtagtacaggtactaaacgtcaagtaataaacgacgacggtctacgtcggaccgtccccgaagtcccggtctttccgtacgtaggaccctacccgaaagggacttcggtaacgttcccggaccaccgggcgtaaacggggtattacgtttacctactaacttcccgtacggtacggggtaccctacccgtaaggttcctagggaaccgtacggtaggtacggggtaccttaggtaaactttaacgtttacggtttcggttttaacgttccggttagggacccttaaacaaccgtaaaccggtccgtaggtacttaccggttccggaaccgttcgggaccctaacgggttcccaacgttccggtacggaccaccggaccccaaacggtccccaaaccccgtacgtacgtaccctaccgttccgtttccccgtacccccg

SEQ ID NO: 403808 - DNA, 791 bp, Homo sapiens
  misc_feature: GZ8MTXP02G0AJM.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtgcacaatgttcgtcctatgacatatattcggtaccacagaagcgagggacgtccctacccgtagttctccgtgacggttacaggtaccaaactcaagtaagtaaaccgacgtacgggtcctacgttacggaccgttccccgaaggccccgttactttccgtaccggttaggaaccccttaccggaaaggggtacttacgggtaaccgtttacccccggaacccggaacggtacccggaaaagggggttactttaaaaccgtttaaccctcggtaaactttcccgttaacggttccggggtacccttacgaaccggttccgtaagggaacccgtaagttccgggaaggtacctacggtaaccttaggtttaaaccgtttgttttaacggtacgtttacgggaacctaaacgtaaaacccgtaccgtacgttaagggtccttaccggtttaccgggaccgttaccgggggtacctaaacgggggtccctaacccgggttacccgtacgggtacccgaaaccgtaccccggaaaaccggccccgaacccctacgttacggtaccgtacccttccggttcccttaaccccccg

SEQ ID NO: 403809 - DNA, 680 bp, Homo sapiens
  misc_feature: GZ8MTXP02F5MBO.13.11.A11.1.454.CMB.2.raw
  modified_base (321)..(321): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgctcctcctggagcgtcagccagtctcacctgcacttgcgcagtggcaccaatgttgtcctatgacatatattggaccgacagaagccgagggactccctacccctagttcctccgtgtacggttcaggtacaaactcaagaactaaacgacgacgggctcgnggacgtccccgagccgtcttctcgtaggacctaccgaaggtctacgtacttcccgaccacggcgaaggggtacttacgttacctcgtactcgttacgtcgggtcctaccgaacgttccaagtaccgacgttaggaacggtcttaacgtactttaaacgtttaccgttggttttaacgtacgtttacgggacctaaaccgtaaacccgaaaccggtccgttacggtaacgttccgtttaaccgggaccgttacgggaacccgtacgggtccctaccggtaccgtacggtaccgaccgaccccggaacgaaccccgtaaacccctacgtaccgtccacctttcccgtaccgtttccccccg

SEQ ID NO: 403810 - DNA, 696 bp, Homo sapiens
  misc_feature: GZ8MTXP02GSCHH.13.11.A11.1.454.CMB.2.raw
  modified_base (240)..(240): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaggtgtccagtgtgaggtgcagctggtagagtcgtgggggagtgtggtacggccgtgggggtccctnagactctcctgtgcactctggattcagatttgatgagtatggcatacacgtcgggtcccaccaacccgtccgaaggggaacggggctgcgtaggtgggtctcgtaggtaataaaacgtggaagtgggtcgccgaagaccaaacctaaactttagtcgactaaggtaaccttcgtagggtacggaaacgggggtccctaaatttcccgaaaccctaacgtttccctaacccgaaaggtacgaaaccgtaggggtaccgaacccggaaacgtaaaacccgttccccgtaaacaacttccgtaacggtaaccaaaaagttacgaaaaccgtacggttcctaacggggacgttaccgggaaaacgggaccgtaccgggtacctttagtttaacgtttcgtacggttcgacgtaagggttacgcgtaggtcgggtctaggttaacttacggactaaacggg

SEQ ID NO: 403811 - DNA, 502 bp, Homo sapiens
  misc_feature: GZ8MTXP02FH90H.13.11.A11.1.454.CMB.2.raw
  modified_base (392)..(392): a, c, t, g, unknown or other
  modified_base (422)..(422): a, c, t, g, unknown or other
  modified_base (445)..(445): a, c, t, g, unknown or other
  modified_base (486)..(486): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagttctcctgaggttcaggtcaaactcagataaacgacagggctcgtggacgtccccagccgctctctggactccaaggatgattccgcacgcgagggatatactcatctctgggctcagtctgacgntgagctagactattactgttgacttggcanaacacgcctggactcgtcggacngggaccacggtcaccgtctacggcacgccaagccaaacccnctcgcactctctcccc

SEQ ID NO: 403812 - DNA, 661 bp, Homo sapiens
  misc_feature: GZ8MTXP02HIOG2.13.11.A11.1.454.CMB.2.raw
  modified_base (238)..(238): a, c, t, g, unknown or other
  modified_base (439)..(439): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtgcacatgttgtcctatgactatatattcggtaccanagaagccgagggacgtccctcccctagtttcctccgtgtacggttcaggtacaaactcaagtaactaaaacgacgaggctcgtaggacgtccccagccgtcttctccgtagacctaccgaaaggtctagtacttacccgacctacggccgaagggtaattacttaactcaacttctacgtggccttacccgagttacccgngaaccgttagacgggtacgggtacttacggttaaccttaaacgttttaccgttaggttttacgtacgtttacgggaccgttaaacctaaacgaacccgtccgttacggtaacgtttccgtaccgggtaccgtacggggtacccacggtacctaccgtcgttaacgccgaccgaccgaacggaaccccaccgtactacggtactaccgtccttaccgtccccc

SEQ ID NO: 403813 - DNA, 480 bp, Homo sapiens
  misc_feature: GZ8MTXP02IA8DC.13.11.A11.1.454.CMB.2.raw
  modified_base (461)..(461): a, c, t, g, unknown or other
  modified_base (463)..(480): a, c, t, g, unknown or other
tcagtcacgtactacacgaccggtgctcgatttagctacgactgcagggccagtcagattgtcagcagcaactacttagcctggtaccagcagaagcctggcccaggccccccaggctcctcatctacgatgtattcaggaggaccatgacatcccagacaggttcagcggcaggtgggtctgggacagacttcactctcaccatcagcagactggaacctgaagtacttttgacttacttttattctgtaccacctaggttaatcggtacggtcctaaccgttacgttaacgtttcggaccgtaaggggaacccaaggtcgtaggagaatacgaaacggacgtaacgtggtggcgtcgaccgacctattcgtcgttccttccctacgttcccttccccactacttcgtacgtagtacgttacgtcgtacgtagggcggcggtcgacgacgaaggcagagngnnnnnnnnnnnnnnnnnn

SEQ ID NO: 403814 - DNA, 579 bp, Homo sapiens
  misc_feature: GZ8MTXP02FVW6U.13.11.A11.1.454.CMB.2.raw
  modified_base (243)..(243): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccganagaagccgagggacgtcctcccctagttctcctgaggttcaggtacaactcagataaacgacaggctcgtaggacgtcccccagcccgcttctcgtggactccgaaggatgacttcccgacctacgcaagggtataacttactcattctacgtgggcctcgaagtctgacgatcgaggctagacttattacttggtttacgacgttcggacaacaaccgaaccgtccgtagggtacttccgtacggaccgtcggacccgtacggtcctacccgtcgtacgtaccgacacccgaaccgaacccaaacccgactacgtaccacgtccttactaccccc

SEQ ID NO: 403815 - DNA, 674 bp, Homo sapiens
  misc_feature: GZ8MTXP02FMYN1.13.11.A11.1.454.CMB.2.raw
  modified_base (241)..(241): a, c, t, g, unknown or other
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttccgcgcagtggcaccaatgttgtcctatgacatatattggaccanagaacgcgaggactcctcccctagttcctccgtgtacggttcgaggtacaactcaagaacgtaaacgacgaggtctcgtacggtaccgtccccgacgcccgtctttcgtcgtggtacctaccgaaggatcgacttcccgaccgacgcgacgggtaattacgttactactactctacgtcgggccctacgacgttctagtacgagtacggacggtacttacgtaactttaacgtttagttagttttacgtacgttacggaacctaaacgaaaccgtaaaccggtccgtacgggttacgttaccgttaccgggtaccgtaaccgggtacccgtaccggtaccgtaacccggttaccgtacggtaccgaaccggaccccgaaaccggaaccccgtaaccctacgtactacccgtacctccggtcccttacccccgg

SEQ ID NO: 403816 - DNA, 677 bp, Homo sapiens
  misc_feature: GZ8MTXP02I8ZM3.13.11.A11.1.454.CMB.2.raw
  modified_base (190)..(190): a, c, t, g, unknown or other
  modified_base (409)..(409): a, c, t, g, unknown or other
  modified_base (544)..(544): a, c, t, g, unknown or other
  modified_base (645)..(645): a, c, t, g, unknown or other
tcagtcacgtactacacgaccggtgctcgatttagctacgactgcagggggctgggcctcaggaggcagcatcggaggtgcctcagccatggcatggatccctctcttcctcggcgtccttgcttactgcacagaatccatggcctctatgagttgactcagccaccctcatcgtccgtcgtccccgganagacagcctacactcacctgcctcgtggatattagtattacgaactaacggagttagttcggttccgtggttatacgagccgaagaacggcacggtccaccgtccccctgtaccctatctacgttactttacaaaactcccgaggccggtcccgtcgtcggggtcccttagcgtccggtatttcccgcccgtccgtcccgcgtacgtacggaaccacgngtccacgttcacgacctagtcgacggaccggaccagtccgtaagtgacgttggccgtcttcgtccgtacgtttcgcgtaaccgtgggtccggtaacgacaacggttcggcggttcggaccggttggggtaccggnggggttaaacggccgtacgtttccggtacggttcccggtttaggttaaaccgccggttaccgacccggtaacgtcccgtccgtcccccggtacgtaccccncgtttcccgttaacctcccccggtttaaaccc

SEQ ID NO: 403817 - DNA, 740 bp, Homo sapiens
  misc_feature: GZ8MTXP02H50QA.13.11.A11.1.454.CMB.2.raw
  modified_base (262)..(262): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcactgcactgcgcagtgcacatgttgtcctatgactatatattggtaccacagaagccaggacgtcctccctagttcncctgaggttcaggtccaaactcagaagtaaacgacgagggctcgtggacgtccccagtcccgtacttcgtcgtggacctcccgaaagggtactcggacttcccgaccgtaccggcgaaggggacttaacgtttacctctaacgttccgtacgtcgggtacccttaccgaacggttctacgacgtaccgttaggacggtcccgttagtacctttaaagtttacccgttagtttacggtacgtttacgggactaaaccgaaaccgtaaacggtccgtggggtaaccttccgtttaccgggaaacccggttaccggggtaacccctaccggggttacccgtaacccggtttacccggtaaacggtttcccgaaaacccggttcccccgaaaaccgggggaaccccccgtaaaacccccctaccgtttacccgggttacccctaacccgtttaaccgggtttcccccgtttaaacccccccg

SEQ ID NO: 403818 - DNA, 689 bp, Homo sapiens
  misc_feature: GZ8MTXP02H6QEZ.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcagtctcacctgcacttgcgcagtgcacaagtgtcgtcctatgactatatagttcggtacgacaagacgccgagggactccctacccagtttcctcctggagttcgaggtacaaactcgaagaataaaccggacgaagggtctacgtacggacgttaccccaggcccgctttcgcgtaggaccctacgaaagctgacgtcccgacacggacaaggattaattacctcattccgtacgtcgggcttaccgagtcgtgaaccgtagtggtaacgcgtataaaccgttatttaccgttaggtttagtaacgttcggaaacaaccgtaaacgaaccgtcccgtaaggtacgttacccggttaccggaaccggttacgggaacccgttaccgggtcccttaaaacccggtttcccggaaacggttcccgaaacccgacccgaaaaccccgggaaccccgtaaaccccctagtcctaacccggttacccttcccggtttaaccccgtttccccccggg

SEQ ID NO: 403819 - DNA, 651 bp, Homo sapiens
  misc_feature: GZ8MTXP02JMPCG.13.11.A11.1.454.CMB.2.raw
  modified_base (243)..(243): a, c, t, g, unknown or other
  modified_base (258)..(258): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcacgcccaccctcaggtcgtccgtcgtccccgaggacagacagccagcatcacctgctctaggaaataatgacagaataatntacttcgtgtatcancagagtcacgcctacgtcccctagtcgctggtctatactactacaagctcgaccaaggccgacctcggaacgggtactcccccggtagacggtctactttcgtcgtacggtcctaaccgtaaccgttcggtacggggtaacctcgaaccgccctacgtcctacggacccagtacccgaacggggccccggaacccgagggtaccttaagggtacggagttacgggcggtacttacggtaactttaacgttccgtaggtacgacgggttcgggtacggacacgccgaaacgccgtaaccggccgacccggtaagttctcgggttccgttaacgggaccggttacgggaaccgtacggtccctaaccggtactacggacccgacgtaaacccccg

SEQ ID NO: 403820 - DNA, 741 bp, Homo sapiens
  misc_feature: GZ8MTXP02GU1A3.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcgcagtgcacaatgttcggtcctatgactatatagttcggaccgacagaagccgagggacgtcctcccctagtttcctcctggtacggttcaacggtacaaactcaagtaataaaccgacgagggtctcgtacggaccgtccccgagtcccgtcttccgtcgtaggacctaccgaaggtacgtacgtacttcccgaccgacggccgaaagggtacttacttaccgtatacgtctcgtcggtacctccgtaggttctacggactagtacggacggtctacgtaactttaacgtttagttcggtttacggtaccgtttacgggaaccttaaaaccgtaaacccgaaacggtccgttaacggttaccgttccggttacccgggtacgttacccgggaaacccgttacccggggtaccgtaaccccgggtttaacggaccggttacccgaaccgggttaacccccgtaaacgggaacccccgtaaaccccctaacgtttcccggaaaccgtttacccttaccccggtttcccgggtttacccccccg

SEQ ID NO: 403821 - DNA, 751 bp, Homo sapiens
  misc_feature: GZ8MTXP02GXE6U.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattcggtaccgacaggaacgccgagggacgtccctcccctagtttctccgtgtacggttcaggtacaaactcagataaacgacgacgggtctacgtggaaccgtccccgaagtcccgccgtttctcgtacgggtaccttacccgaaggtacgtagtacgttccccggaccaacgggtccgaagggggtaacttaactttaccgtacctattcccgttacgttcgggggaaccctttcccgtaggttacttacgggaacggtaacttcggggaaacgggtctaacggtacctttaaaggtttacccgttggtttaccggtacgtttacggggaacctaaaaccgaaccgtaaaccgtcctagggtaacttccggtttccgggaaccgttacggggtaaccctacggggtcctaacccggttaccgtagggttcccaaaccggtacccgtaaaaccggggcccccaaaacccccgtgttacccggtaaccctaaccggtttcctacccggttttaaacccccc

SEQ ID NO: 403822 - DNA, 403 bp, Homo sapiens
  misc_feature: GZ8MTXP02G7IGW.13.11.A11.1.454.CMB.2.raw
  modified_base (215)..(215): a, c, t, g, unknown or other
  modified_base (254)..(254): a, c, t, g, unknown or other
  modified_base (307)..(307): a, c, t, g, unknown or other
  modified_base (398)..(403): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtggtctgcgacaaacttcactctcaccgtcaccagactggancctgagatttgcagtatatcctgtcactagttgtgactnaacgtggacgttggacagtcgggacaaaggtaggaaatggaaaacgaactggnggctcgacaccatcgtgtcttcactccttcccgcctatccctgtactagtactgacgtgacgggcgggcttgggacaagggccgagatagnnnnnn

SEQ ID NO: 403823 - DNA, 384 bp, Homo sapiens
  misc_feature: GZ8MTXP02JOZMA.13.11.A11.1.454.CMB.2.raw
  modified_base (364)..(364): a, c, t, g, unknown or other
  modified_base (371)..(384): a, c, t, g, unknown or other
tcagtcacgtactacacgaccggtgctcgatttagctacgactgcagggccagtaagattgtcagcagcaactacttagcctggtaccagcagaagcctggccaggccccccaggctcctcatctacgatgtattcaggagaccactgacatcccagacaggttcagtggcaggtgggtctgggacagacttcactctcaccatcagcagactggaaacctgaagtactttgacttacttttattctcgtccaccgtagttatggtaactggtgctagcaccatctgttcctactactccttccccgctatctgaatacgtacgtgaccttggacggccgggtgtacggaccgtaagggcctanagtacgnnnnnnnnnnnnnn

SEQ ID NO: 403824 - DNA, 752 bp, Homo sapiens
  misc_feature: GZ8MTXP02GDCMH.13.11.A11.1.454.CMB.2.raw
  modified_base (198)..(198): a, c, t, g, unknown or other
  modified_base (240)..(240): a, c, t, g, unknown or other
  modified_base (315)..(315): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacctgcncagtgcacatgttcgtcctatgactatatagttggtaccganagagcgagggactccctccctagttcctcctgtacggtcaggtacaaactcaagaataaacgacgacgggctcgnggaccgtccccgagtcccgtcttcgtcgtcggacctaccgaaggtatacgtacttcccgaccgacgcgaagggtacttaacgttacctactagtcctcgtcgggtcctcgtagtctagacgtgtagacgtctacgtactttaagttacgttggtttacgtacgttacgggaacctaaccgaaaaccgtaacggtccggttacggtaaccgtttccggttacccgggtaaccggtacccgggggtaacccgtaaccccgggttaccccggttaaaccccggttcccggttaaaccggggttacccccggtaaacccggtaaccccccggtaaaaccccgggggtaaccccccctaaaaacccccccggttcgtttaccccgggttaaccccttaaaccccgggtttcccccttttaacccccggtttcccccccccgg

SEQ ID NO: 403825 - DNA, 795 bp, Homo sapiens
  misc_feature: GZ8MTXP02FNK26.13.11.A11.1.454.CMB.2.raw
  modified_base (237)..(237): a, c, t, g, unknown or other
  modified_base (287)..(287): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtgcacatgttcgtcctatgacatatattggtaccanagagcgaggacgtcctccctagttctcctgacggttcacggtacaaactnagaactaaacgacgaggtctcgtggacgtccccgagcccgtcttcgtcgtggacctaccgaaaggtatacgtacttcccgaccacgccgaaggggtactacgttaacctactaacgttcttaccgtcgggggtacccttacccgtaaacggttccgttacggtaaaccgtaggtttacgggaacgggttaccgttaacggtaaacccttttaaagtttaacccggtttagggttttaacgtaaccggttttaccggggtaaacccgaaaaccttaaaaccccggaaaaccggttccccgttaaggggttaaccgttaccgggtttaacccgggtaacccggttaccgggggtaaaccccgtaaccggggttacccgtaaacccggtttacccggttaaaccggggtaccgtaaacccggacccccgtaaaaaccggggcccccgtaaaaaccccctaccggttaccggtacccgtaaccttacccggtttacccgtttccccccccgg

SEQ ID NO: 403826 - DNA, 394 bp, Homo sapiens
  misc_feature: GZ8MTXP02JJ8I3.13.11.A11.1.454.CMB.2.raw
  modified_base (340)..(340): a, c, t, g, unknown or other
  modified_base (388)..(388): a, c, t, g, unknown or other
  modified_base (391)..(394): a, c, t, g, unknown or other
tcagtcacgtactacacgaccggtgctcgatttagctacgactgcagggccagtcagaatgttggcagcccttatttagcctggtatcaacagagacttggccaggctcccaggctcctcatccatggtacctccaacagggccactggcgtcccagacaggttcactggcggtgggtctgcgacaaacttcactctcaccgtcaccagactggagcctgaagattttgcagtatattcctgtcactagttgtgactcaacgtggacgttcggcatgggaccaaggtggaaatgaaacgaactgtaggctgcacatctagtcttcattccttcccgcctntccctgatacgtacgtgaacttgacggcgggctgggccaaggcgctanagnnnn

SEQ ID NO: 403827 - DNA, 436 bp, Homo sapiens
  misc_feature: GZ8MTXP02I1EA5.13.11.A11.1.454.CMB.2.raw
  modified_base (424)..(436): a, c, t, g, unknown or other
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcaggtgggtctgggacagacttcactctacaccatcagcagactcggaacctgaacgtactttgacttacttttatttctcgtctaacctagtatggtaggtcaccgtacacgttttggccgagggaccaagcgtggagatacaagcgaacgtggtggactcgacaccatctgttcttcctatccttcccgacactctgtactacgtacgtgtacgtggacggtcgggcgtacggacgaggccgactagagnnnnnnnnnnnnn

SEQ ID NO: 403828 - DNA, 553 bp, Homo sapiens
  misc_feature: GZ8MTXP02H71Q4.13.11.A11.1.454.CMB.2.raw
  modified_base (255)..(255): a, c, t, g, unknown or other
  modified_base (370)..(370): a, c, t, g, unknown or other
  modified_base (374)..(374): a, c, t, g, unknown or other
  modified_base (385)..(385): a, c, t, g, unknown or other
  modified_base (397)..(397): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccgtggagcgtcagccagtctcacctgcaccttgcgcagtcggcaaccaattgttgtcctatgactatatatggaacacagaagcaggacncctcccattctcctgagttcagtacaaactcagaataaaacgacgaggctcgtaggacgtcccagccgcttctcgtggactacaaagatgactccgacacgcaaggatattaacncatncgtcgactacngtagtgacgagngcgagtagtacgtacttagttgttacgtagtacgacgaacgaaacgaacgacgtacgtacgtacgtacgtacgacggaccgtacgtaccgtaccgtacgtacgacgaccgaaccgaaccgaaccgaaccgactactactacctccgtaccgtcccg

SEQ ID NO: 403829 - DNA, 667 bp, Homo sapiens
  misc_feature: GZ8MTXP02I0368.13.11.A11.1.454.CMB.2.raw
  modified_base (306)..(306): a, c, t, g, unknown or other
  modified_base (374)..(374): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcaggtggaccaacctaagttgttggtccctatgactatatagttggtaccacgagaacgcgagggactccctccctagttcctccgtgtacggttcaggtacaactnaagaactaaacgagaggctgtagggacctcccgagtcccgtcttcctcggtcggtactaccgaaagtntacgtacgtccgaccgacgtcgaaggtacttacttacgctaagtttccacgttacgggcctacgaaggttctagaaccgagtaggaacgtcgtaaggtatttaaacttgttacggtttcgtaacgttccggactaaacccaaacggtaaccgtcccgtagggttaacttcccgtacgggtaaacccgtcgggtaaacccgtcgaacccttaccgggtacacgggtaccaaccgggtacccaaaccggaacccctaacccggtatcctaaccgtaccgtcttacccgtaccccc

SEQ ID NO: 403830 - DNA, 722 bp, Homo sapiens
  misc_feature: GZ8MTXP02F6PO7.13.11.A11.1.454.CMB.2.raw
  modified_base (370)..(370): a, c, t, g, unknown or other
  modified_base (641)..(641): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccgtggagcgtcagccagtcctcacctgcaccttgcgcagtggccaccaatgttcggtcctatgacattatagttcggtaaccgacaaggaacgccgagggaccgttccctccccgtagtttcctccgtggtacggttacgagtacaaactcaagaactaacgacgacggcctcgtacggaccgtccccgaggtcccgtacgttcncgtacggacctaccgaaggaactcgtacgttacccgaccgacgcgaaaggtatacttcgtactacgtcttacggtcggtcccttacgacggttcgttaacggacgtaggtacgggtacgtaccgtttacgtaaacttttacggttttaaccggtttggtttaacgtaccgtttacgggaaacctaaaaccgtaaccccgaaacgggttcccgttaggtaacgtttcccgtacggggtaaccgggtacccgggaaacgtcccggttaacccnccggttaaacggttcgacgacccgacccggaaaccgtaaccccaaccgtcgttactacctacctcggttcccctacccccg

SEQ ID NO: 403831 - DNA, 639 bp, Homo sapiens
  misc_feature: GZ8MTXP02IQELU.13.11.A11.1.454.CMB.2.raw
  modified_base (246)..(246): a, c, t, g, unknown or other
  modified_base (258)..(258): a, c, t, g, unknown or other
  modified_base (497)..(497): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttgggctgagcttgggttttccttgttgcttaattttaaaaggtgtccagtgtgaggtgcagctggtagagtcgtgggggaggtggtggtacggccgtgggggtccctnagctctcctgtncaacctctggattcgagtattgatgagtagtggacatacacgtcgggtcccaccaacccgtccgaaggggacgggctgcgaggtcggtctcgtagtaataaacgtggagtggtcgccagacaactaacttgtcgacaagtacctcgtggtacggaaacgggtccctattaccaccctagtcccacaaggacgtacacggtccgaaccgtagtaaaccccgttccgtaaacagtttcganaaccgtaaaagtaccgaaacgtacgttaccggtacgggaagtaccgggacggaacccgtaccggttctttagttaactttcgaggtccggaacgtaggttagcgtagggtcgtaccgtaggttacctacggacgttaacggg

SEQ ID NO: 403832 - DNA, 675 bp, Homo sapiens
  misc_feature: GZ8MTXP02FV8Y5.13.11.A11.1.454.CMB.2.raw
  modified_base (192)..(192): a, c, t, g, unknown or other
tcagtcacgtactacacgaccggtgctcgatttagctacgactgcagggggctgggcctcaggaggcagcatcggaggtgcctcagccatggcatggatccctctcttcctcggcgtccttgcttactgcacagaatccatggcctcctatgagttgactcagccaccctccatcgtccgtcgtccccgganagacagcctacatccacctcgctcgtggatatgtattgaactaacggagttattggttctggtatcgagcgagaaggcgacggccaccgtccccctgtacctactctacttacctttaacaaaacgtaccgacggcccggtacccctcggtccggggtccctagacgtcgtacttccgtccccggtccctccgccgtacgtacggaaccacgtcgtcacgtctacgacctacgtccgaacggacccggacccgacgtacctacgttagtacgtacggacggtcgttacgttccttaccgttcgttacggtacggtacgggtacgggtacgggaaccggaacgtacggtcggtcggttcggttcggggttcggggttacggggacgggtacggtacgtacggttcgtacggttacgttacggtacgaccgtttttaccgacgtccgtccgtcccgtcgtccgtacctccgtccgtccctacccg

SEQ ID NO: 403833 - DNA, 655 bp, Homo sapiens
  misc_feature: GZ8MTXP02IAN67.13.11.A11.1.454.CMB.2.raw
  modified_base (535)..(535): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtcccgtcgtccccagggacagacagccagcatcacctgctactaggaaataattgcagaataaatatacttctagtatcagacagagtcacggccacgtcccctagtgctggtcatctaatcaaagactacccgaaaggtccggacccctacgacgggtacctcccgtagacgtcctacttctcgtacggccttcccgaaacttcgtacgggaacctaccacggaccctactactacgacctacgtacgacggaccgggaacccgacggtcgttacggtaggacgtacgggtacggaccgttagtaacgtttacttacggttaggtacccggaggggtcggtacgggaacgacgaccgngaccgtcgttaccgtcccgttaccgtaccgggaaacgtaccggggtacctaaaccgggttccgaaccggttccgtacggtacccgtaaccgacccgtaacccggaccccaacccgtaccg

SEQ ID NO: 403834 - DNA, 338 bp, Homo sapiens
  misc_feature: GZ8MTXP02JP65G.13.11.A11.1.454.CMB.2.raw
  modified_base (326)..(326): a, c, t, g, unknown or other
  modified_base (332)..(338): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggaactgtgctgcacatctgtctcatcttcccgcatctgatagtacgtgactgacgcgggctcggcaaggccngatagnnnnnnn

SEQ ID NO: 403835 - DNA, 364 bp, Homo sapiens
  misc_feature: GZ8MTXP02HXX1R.13.11.A11.1.454.CMB.2.raw
  modified_base (243)..(243): a, c, t, g, unknown or other
  modified_base (256)..(256): a, c, t, g, unknown or other
  modified_base (264)..(264): a, c, t, g, unknown or other
  modified_base (351)..(364): a, c, t, g, unknown or other
tcagtcacgtactacacgaccggtgctcgatttagctacgactgcagggccagtcagattgtcagcagcaactacttagcctggtaccagcagagcctggccaggcccccaggcctcctcatctacgattgtattcaggaggaccactgacatcccagacaggttcagtggcagtgggtctgggacagacttcactctcaccatcagcagactggaacctgaaagctttgctacttttattcngtacaccagttanggaactgnggctgcaccatctgtctctactcttcccgctatctggtatagtcgtagacgtgacggcggggactggggaccaaggccgacagtagnnnnnnnnnnnnnn

SEQ ID NO: 403836 - DNA, 391 bp, Homo sapiens
  misc_feature: GZ8MTXP02FQLVP.13.11.A11.1.454.CMB.2.raw
  modified_base (385)..(391): a, c, t, g, unknown or other
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcaggtgggtctgggacagacttcactctcaccatcagcagactggaacctgaagtctttgctacttttattctgtcaccagtatggtaggtcaccgtacacttttggccaggggaccaagctggagatcaagcgaactgtggctgcacatctgtctcatccttccgctatctgctagtacgtgaccttgacgcgggctggacaaggcgcatagnnnnnnn

SEQ ID NO: 403837 - DNA, 716 bp, Homo sapiens
  misc_feature: GZ8MTXP02G51DW.13.11.A11.1.454.CMB.2.raw
  modified_base (198)..(198): a, c, t, g, unknown or other
  modified_base (353)..(353): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcncagtgcaccaatgttggtcctatgacatatagttcggtaaccgacaggaacgccgaggggactccctcccctagttcctcctggtacggttcaggtaccaaactcaagaactaaacgacgagggcttcgaggaccgtccccaggtccgtacttcncgtaggacctacgaaaggtctcgtacttcccgacgacgcgaaggtacttattacgctatctcgtcggtactccgagtctaggacgtatggaacggtctacgaactttaacgttacgtttggttaccgtagtttacgggaaccaaacccgtaaacgtaaacccggtccgttaacgggggtaacctttcccggttaacccgggggtacccgttaccggggggtaaaacccctccgggggttaacccttaaccccggttaaccggtaccggggttacccaaaacggacccccaaaaccggggtaacccccaaacccccgtaacgttccggttacccacctttcccgtttaccccggtaaccccccc

SEQ ID NO: 403838 - DNA, 661 bp, Homo sapiens
  misc_feature: GZ8MTXP02JL4O8.13.11.A11.1.454.CMB.2.raw
  modified_base (241)..(241): a, c, t, g, unknown or other
  modified_base (275)..(275): a, c, t, g, unknown or other
  modified_base (291)..(291): a, c, t, g, unknown or other
  modified_base (368)..(368): a, c, t, g, unknown or other
  modified_base (385)..(385): a, c, t, g, unknown or other
  modified_base (442)..(442): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccatggagtttggctgagctgggttttccttgttgctattttaaaaggtgtccagtgtgaggtgcagctggtagagtcgtgggggaggtgtggtacggccgtgggggtccctnagactctcctgtcgcaacctcgtaggattgagtntttgatgagtactganatacacgtggtcccaccaaccgtcggaagggaaggggctggctaggtggtctcgtaggtataaacgtgaacctggcnccagcgaacaactttancggtacacggtacttcgtagttacgggaaaggggtccccaatttcccaaaacccttntccctacgaaagtacgaacgtacggtcgaaccgtaacgtaaccttccggtaaacacttacgaacgaaaccgtaaataacgaacgtacgtacgtacggtacggtacggaacggtaccggtaccgtacgttacgtttacgtttcgttacggtacggtacggtacggtacggtaacggtacggtacggtacggttacggttaaccgttaccgtacgtaacgg

SEQ ID NO: 403839 - DNA, 598 bp, Homo sapiens
  misc_feature: GZ8MTXP02GL3V3.13.11.A11.1.454.CMB.2.raw
  modified_base (242)..(242): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttggtcctatgacatatagttcggtaccanagaacgccgaagggacgtccctccccgtagttcctccgtagtacggttcaggtacaaactcaagaactaaacgacgagggctcgtcggacgtccccaggccgtcttctcgtaggactaccgaaggtatgacttccgacacgcgaaggtatacttactcatctcgtggctccagtctagacgagtgaggtctacgtactttaatttacgttggttttacgtacgtttcggacaaacaaaccgtaacgccgttagtacttccggttaccggacgtcgggaaccctacggtactacccggtacgtacggtcaccgacccgaacgaacccaaacccgctactccacttcctacttccccc

SEQ ID NO: 403840 - DNA, 679 bp, Homo sapiens
  misc_feature: GZ8MTXP02I3V7W.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtgcaccaatgttcgtcctatgacatatattggtaccgacagaacgcgagggctcctccctagtttctcctgtagttcacggttacaaactgagaagtaaacgacgaggtctacgtcggaccgtccccagcccgtactttccgtcgtcggtactacccggaaggtacttacgtacgttacccgacccacgggtccgaagggtaacttacgttacctacgactttaccggtcgtcggggtacctacgtacggtcttggacgtacggtaggacggtctaggtaacttaacgttacgtttggttacgttacgttacgggaccttaaaccgaaccgtaacggccgtttacggggtaactcggtttacccggaccgtacgggtaaccctacgggtaccctaccggtactacggtccgaaccgcccgtaaaccggcccctaaaccctctaccggttcgaccctaccgtttacccgttaacccccg

SEQ ID NO: 403841 - DNA, 877 bp, Homo sapiens
  misc_feature: GZ8MTXP02H4MR2.13.11.A11.1.454.CMB.2.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgtcttctccgtggagcgtcagccagtctcacctgccaccttgcgcagtgcacaagtgttcgtcctatgactatatagttacgacgacgaagaacgccgagggactccctacccctagtttcctccgtaggtacggttacgaacggtaaccctaaacgtacgaaaggtaaacgtaaaaaccggacggtaacggggtccttacggtacggggtaaccccgttacccccgaaggtccccggttacctttaccgtccggtaagggtacccgtaacccgaaaagggtacgtacggtaccgttaccccggaacccgtaaccggaccgggtaaagggtaaactttaacttaaccgtacgtaactttcccgtaccgttacggggaccccttacgtacgttaccggaacggtaccgtaagtacgggtaacggtacttaccggttaaatttaaacgtttcggtttggtttaacgtaaggttccggaaacctaaaccgtaaaaccgtaaccggtccttaacgggtaccgtttaccggtttacccggggaaacccgggtaccgggtaaaacccgtacccggtttacccggtaacccggttaacccggtacgggttaaccccgaaacccggtaacccccgaaaaccggggtaacccccctaaaacccccgttacggtacccggttaaaccctcccggtttaccccttttacccccggtttaaaccccccccg

SEQ ID NO: 403842 - DNA, 631 bp, Homo sapiens
  misc_feature: GZ8MTXP02JAVJH.13.11.A11.1.454.CMB.2.raw
  modified_base (137)..(137): a, c, t, g, unknown or other
  modified_base (237)..(237): a, c, t, g, unknown or other
  modified_base (312)..(312): a, c, t, g, unknown or other
tcagtcacgtactacacgaccggtgctcgatttagctacgactgcagggggcctgggcctcaggaagcagcatcggaggtgcctcagccatggcatggatccctctcttcctcggcgtccttgcttactgcacaggntccgtggcctcctatgagctgactcagccaccctcagtgtccgtcgtccccaggacagacagccagcatcacctgctctaggaaataatgcagaataatntacttctggtatcagcagagtcaggccacggtcccctgcgctggtcatctatacaagatcgaccaagccggcctnacgggctccccgtgacgtcgtactttccgtacgtcgcctcctaaacgttccgtacggggtaaccctcgaacgtccctaacgttctacgaaccctagaccgacgggacccggaacccgaggtaccgtaggtaggaacgtggaacgtccttaggtaacttaagttaccggtacgtaccggaggggtccggtaggggacctaagggcccaggacctacgtaccgcccgtacgttacgtccggttaccggtaaccggtaacggtaccggggaaccgtaagggtaccccctacggtaccgttaaacgtccgaaccggaaacccc

SEQ ID NO: 403843 - DNA, 750 bp, Homo sapiens
  misc_feature: GZ8MTXP02JIAAA.13.11.A11.1.454.CMB.2.raw
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctatgcttctcctggagcgtcagccagtctcacctgcacttgcgcagtgcactatgttgtcctatgacattatattcggtaccgacaagaaggaccgagggtacgtccctacccctagttcctcctggtacggttcaggtactaaacgtacagaataaacgcgtaggctcgtaggaccgtcccgacgtccctctacctcgtaggaccctaccgaagggtactacggtaccgttacccgaccgaaccggggtctaaacggggtattaaccgtttaacctacttaacgttcccgtacggttcggggtacccttaccgtaacgggttaccgttaacggacgtaaggttcgggaacgtccgttagtaacgtttaactttcggtttaggtttacggttaaccgttacgggacctaaaacgaaaacccgtaccgttaccggtaggttacttaccgggttacccggtaccggtaacggggtacccgtaccgggtaccgtaacccggttacgtaaaccggttccgaaccgtacccggaaaccggtaacccccaaccccgttacgacccgttaccctaacgttccccttccggtttaacccccc

SEQ ID NO: 403844 - DNA, 648 bp, Homo sapiens
  misc_feature: GZ8MTXP02FXAIK.13.11.A11.1.454.CMB.2.raw
tcagtcacgtactacacgaccggtgctcgatttagctacgactgcagggggtaagagggttgtgtccaccatggcctggactcctctcctcctcctgctcctctctcactgcacaggttccctctcgcaggctgtgctgactcagccgttcttccctctctgcttctcctggagcgtcagccagtcctcacctgcaccttgcgcagtcggcaccaagttcgttcggtccctatgactatatattcggtaccgacagaacgccgagggactccctcccgtacgtttcctcccttaggtacggttacaggtacaaacgtcgaagaagtaaacgacgaggctcgtggacgtcccgagtccgtctctcgtcgactccgaaggtactgtacttccgaccgaacgcgaagggtactacttacgtactactcgtacgtcggtctacacgtctagacgtagtgacgtactagtacttaacttacgtttcggtttataccgtttagggaccaaaccgtaacgtaaaccggtccgttaggtaacttccgttacggaccgtacgggaccgtaccggtaccgtaccggttacgtaccggttaccaccggtacccgaaacggtcccaacccgtacgtcggtacctaccgttcgtttccccg

SEQ ID NO: 403845 - DNA, 646 bp, Homo sapiens
  misc_feature: GZ8MTXP02G6PZ6.13.11.A11.1.454.CMB.2.raw
  modified_base (201)..(201): a, c, t, g, unknown or other
  modified_base (376)..(376): a, c, t, g, unknown or other
  modified_base (625)..(625): a, c, t, g, unknown or other
  modified_base (631)..(631): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctccgtggagcgtcagccagtctcacctgcaccttgcncagtggcaccaattgttcgcctatgactatatattggaccgacaagtacgcgaggcgtacctccctagtttcacctggacgttcgaggtacaactacgagaaataacgacgtacgggtctacgtacgggacgtccccgacgtaccgtcttcgtcgtacggtactaccgaaaggtntacgtaccttccgaccgaacggactaggggtaaactcgtttaacactactactcgtacgggccttccgtaggttacgttacgaacggtagttacggaacggtcctaggtaaacttttacgttacgtttgttacgtaccgtttacgggaccaaccgtaaacgacggtctaacggtacttaccgtacgacccggttacgacccgttaacggcctaccggtacgtcgaccgaccgaccgaaccgccctaacnccgtancctacggctttaccc

SEQ ID NO: 403846 - DNA, 621 bp, Homo sapiens
  misc_feature: GZ8MTXP02JG5Y1.13.11.A11.1.454.CMB.2.raw
  modified_base (134)..(134): a, c, t, g, unknown or other
  modified_base (279)..(279): a, c, t, g, unknown or other
tcagtcacgtactacacgaccggtgctcgatttagctacgactgcaggggagctctgggagaggagccccagccctgagattcccacgtgttgccattcggtgatcagcgctgaacacagaggactcgccagtnttagtttgggctgagctgggttttccttgttgcttaattttaaaaggtgtccagtgtgaggtgcagctggtagtagtcgtgggggaggtggtgggtacggccgtgggggtccctcagactctcctgtgcaacctctggatcagtnttgatgagtatggcatacacgtgggtcccaccaaccgtccgaggggtaagggctaggcgaggtcggtctcgtagtaagtaaacgtggaagtggtgacccagcacgaactttagcgtacacgtacgttgtcgtaacgggacgggaccgtacttaccaaacctcggtacctacgaccgatacgacgtacgtacgaaaccgtacgtaacctaccacgtacgacctaagaacaaagtacgtaacgacggtacgtcggaacgtacgaacggtaccgtacggttcttacgttgtcgtcgtacggtagtacgtcgtcgtgtacggtacgttcgaaaacgtttcggaacg

SEQ ID NO: 403847 - DNA, 745 bp, Homo sapiens
  misc_feature: GZ8MTXP02GPVZ4.13.11.A11.1.454.CMB.2.raw
  modified_base (317)..(317): a, c, t, g, unknown or other
  modified_base (340)..(340): a, c, t, g, unknown or other
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacaatgttggtccctatgacatatattggtaccagagaagccaggggactccctcccctagttcctcctgaggttcaaggtcaaactcaagataaaccgacaggggctcgnggaacctcccgagccggtcttcncgtggacctaccgaaggtatggacttcccgaccaaccggcgaaggggtaactaacgtttacctactacttccgtacggttcgggtaccctacccgaagtttccgtagggaacccgtagttacgggaagggtacccttagggtaaccctttaaagtttaccgtttaggtttttacggtaaccgtttcgggactaaaaccaaaacccggaaaccgtccggtaaggtacccgttcggtttaacccgggaccggttacggggaaccccggtaaacccgggttccgtaaccccggtttaccgtaaccgggtccgaaaccgggacccccgtaaaccggggaaccccctaaaacccccggaacttcccggtaccctaaccgtttccccggttaacccggtttacccccccgg

SEQ ID NO: 403848 - DNA, 398 bp, Homo sapiens
  misc_feature: GZ8MTXP02HV98C.13.11.A11.1.454.CMB.2.raw
  modified_base (240)..(240): a, c, t, g, unknown or other
  modified_base (297)..(297): a, c, t, g, unknown or other
  modified_base (306)..(306): a, c, t, g, unknown or other
  modified_base (337)..(337): a, c, t, g, unknown or other
  modified_base (341)..(342): a, c, t, g, unknown or other
  modified_base (351)..(351): a, c, t, g, unknown or other
  modified_base (354)..(354): a, c, t, g, unknown or other
  modified_base (356)..(356): a, c, t, g, unknown or other
  modified_base (362)..(362): a, c, t, g, unknown or other
  modified_base (364)..(364): a, c, t, g, unknown or other
  modified_base (370)..(370): a, c, t, g, unknown or other
  modified_base (372)..(398): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatccagacaggttcagtggcagtgggtctgggacagacttcaactctcaccatcagcagactggaacctgaaagctttgctactttattcngtcacagtatgtaggtcacgtactactttgccagggaccaaagctggagatcaaagnggaaactgnggctgcacaatctgcttcatccttccgctancgtnntagttacgngangngcgcgngngagcgnannnnnnnnnnnnnnnnnnnnnnnnnnn

SEQ ID NO: 403849 - DNA, 396 bp, Homo sapiens
  misc_feature: GZ8MTXP02F6DTL.13.11.A11.1.454.CMB.2.raw
  modified_base (290)..(290): a, c, t, g, unknown or other
  modified_base (303)..(303): a, c, t, g, unknown or other
  modified_base (305)..(305): a, c, t, g, unknown or other
  modified_base (380)..(380): a, c, t, g, unknown or other
  modified_base (382)..(382): a, c, t, g, unknown or other
  modified_base (384)..(396): a, c, t, g, unknown or other
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagtactttgactactttattctgtctaccagtatggtagtcacgtacatttgccagggacagctgganatcaagcgaatgngntgcaccatctgtctcacttcctccgcctatcctgtactagtacgtgaccgtgaggtcgggctggaccgaggcganangnnnnnnnnnnnnn

SEQ ID NO: 403850 - DNA, 711 bp, Homo sapiens
  misc_feature: GZ8MTXP02F26UF.13.11.A11.1.454.CMB.2.raw
  modified_base (275)..(275): a, c, t, g, unknown or other
tcagtcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcaccaatgttcgtcctatgacatatagttcggtaaccgacaagaacgcgaggacgtcctcccagtttccnccgtggtagtcagtcaaactcgaagaagtaaacgacgagggcctacgtacggaccgtccccgaggtccgtcttccgtcgtacggtactccgaaaggtactacgtaaccgttcccgaccgtaacggccgtaagggtaacttacttactcgtaattcccgtacgtcggtcctaccggtacgttacccgtaggtaccgtagttacgggaacggtcgttaacggttaactttaacgtttaacgtttacgggtttagtaaccgtttcgggaacctaaaccggtaaccgtaaccggtccggttaaagttccgttacgttaccgggtaccggtaccgggaccgtaccgggtcctaacccggttacgtacggtaccaccggtaaccccgtaaacggaccccctaaccgtacgttaccgtccgtaacccgttcgtttaacccccg

SEQ ID NO: 403851 - DNA, 536 bp, Homo sapiens
  misc_feature: GZ8MTXP01BE9TM.3.70.G04.1.454.CMB.2.raw
  modified_base (369)..(369): a, c, t, g, unknown or other
  modified_base (515)..(515): a, c, t, g, unknown or other
tcagagacgcactccacgaccggtgctcgatttagtgtagtgtgaagggaaaggggaggaactgctcagttaggacccagagggaaccatggaagccccagctcagcttctcttcctcctgctactctggctcccagataacaccgggcaaactgtgttgacacagtctccagccaccctgtctttgtccccaggggagacagccaccctctcctgcagggccagtcagagtgttaggggccacttagcctggtaccagcagaaacctggccagccctcccagtctcctcatctatggagcacacaacagggccactggcatcccagccaggttcagtggcagtcgggtctgggacagacttcaccctnatcatcagccgctagacgcctagaagtatttgacttagtttattactgtcagtctagggttacttcggtcggccctacgtttccgggccctgggaccaaaggtggaatatacaaacgactggtggctgctacattcgttgttcttnatccttcccgcatcgttgaag

SEQ ID NO: 403852 - DNA, 525 bp, Homo sapiens
  misc_feature: GZ8MTXP01AJ9N4.3.70.G04.1.454.CMB.2.raw
  modified_base (381)..(381): a, c, t, g, unknown or other
  modified_base (492)..(492): a, c, t, g, unknown or other
  modified_base (505)..(505): a, c, t, g, unknown or other
  modified_base (524)..(524): a, c, t, g, unknown or other
tcagagacgcactccacgaccggtgctcgatttagtgtagtgtgaagggaaaggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccattagcctggtaccagcagaaacctggccagcctccagctcctcatctatggagcacacaacagggccactggcatcccagccaggttcagtggcagtcgggtctgggacagacttcaccctcatcatcagccgctagncctgaagtatttgctagtttatactgtcagcagggtttactcgtcggccctacgtttccggcccttgggacccaaagtcggatcgtacaaacggactggtgctgcaacctnttcgttcttctcnctcctccgcttatcgttgng

SEQ ID NO: 403853 - DNA, 407 bp, Homo sapiens
  misc_feature: GZ8MTXP01BEFBP.3.70.G04.1.454.CMB.2.raw
  modified_base (287)..(287): a, c, t, g, unknown or other
  modified_base (402)..(407): a, c, t, g, unknown or other
tcagagacgcactccacgaccggtgctcgatttagtgtagtgtgaagggaaagggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagctcacaggccancggtctcccctgcgcctgctccaggagcacctccgagagcacagcggccctgggctgcctggtcaacggactacttccgagtgcgtctctgagcgggctgggcaaggcgcatagnnnnnn

SEQ ID NO: 403854 - DNA, 419 bp, Homo sapiens
  misc_feature: GZ8MTXP01C83Z0.3.70.G04.1.454.CMB.2.raw
  modified_base (271)..(271): a, c, t, g, unknown or other
  modified_base (414)..(419): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactgggggcctgggaaccctgggtcaccgtntcctcagcctccaccaagggcccatcggtcttccccctggcgccctgctcaggagcacctccgagagcacagcggccctgggctgcctggtcaacggactacttccgagtgcgtctctgagcggggctggcaaggcgcatagnnnnnn

SEQ ID NO: 403855 - DNA, 425 bp, Homo sapiens
  misc_feature: GZ8MTXP01EIK62.3.70.G04.1.454.CMB.2.raw
  modified_base (293)..(293): a, c, t, g, unknown or other
  modified_base (305)..(305): a, c, t, g, unknown or other
  modified_base (420)..(425): a, c, t, g, unknown or other
tcagagacgcactccacgaccggtgctcgatttagtgtagtgtgaagggaaagggccggagtgggtctcaattatttatggcgatggtagtacgtactacgcagacctccgtgcagggccgattcaccatctccagagacaatttcaagaatacgttgctccttcaaatgaacaacctgagaaccgaggacacggccgtatattattgtgcgagtagtacggtggtgaatggtgggtgttaacgtggggcctgggaaccctggtcaccgtctcctcagcctccacaggcccancggtcttccccnggcgccctgctccaggacgcacctccgagagcacagccggccctgggctgcctggtcaacggactactccgagtcgcgtctcgtgacggcgggctgggcgaagggcgacagtagnnnnnn

SEQ ID NO: 403856 - DNA, 587 bp, Homo sapiens
  misc_feature: GZ8MTXP01DE3AW.3.70.G04.1.454.CMB.2.raw
  modified_base (382)..(382): a, c, t, g, unknown or other
tcagagacgcactccacgaccggtgctcgatttagtgtagtgtgaagggaaagggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccaggcccggggggtccctgagactctcctgtgaagtctctgggttcactgtcagtagcaactacatgaactgggtccgccaggctccgaggggaaggggccggagtgggtctacgtaatttatttatggcgatggtagtacgtactacgcagactccgtgcngggccattccaccatctaccagagtaaaatttcaaagaatacgttgacttccttacaaatgaaacaacctagacgaaccggaaggaccacggccgtatattattgtagcgtagtaggtacggtggtaagaagttggtgggttgttaaacgtgggggccttggggaacccctgggtccaaccggtctccttcaacgccctaacccg

SEQ ID NO: 403857 - DNA, 594 bp, Homo sapiens
  misc_feature: GZ8MTXP01EBJTA.3.70.G04.1.454.CMB.2.raw
  modified_base (303)..(303): a, c, t, g, unknown or other
  modified_base (379)..(379): a, c, t, g, unknown or other
  modified_base (405)..(405): a, c, t, g, unknown or other
  modified_base (588)..(588): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccgaggggagacagcccaccctctcctgcagggccagtcagagtggttaggggccattagcctggtaccagcagaaacctggccagccctcccagtctcctcatctatggancaacacaaacgcggccacgtggcactccccagccaggttcagtggcaggtcgggtctgggacagacttccaccctnatcatcagccgctagagctagaagtnttttgcttaagtttattactgtacagtcgtaagggtttcttcggtcggtccccttacgtttcccgggacccttaggggaaccctaaaggtggaacttaacgtacgaaaacgtacgtaaggtcggactcgccaaccctattccgttcgttaccttctaacttccctttccccgcttactttcgngtaagg

SEQ ID NO: 403858 - DNA, 415 bp, Homo sapiens
  misc_feature: GZ8MTXP01BYTKX.3.70.G04.1.454.CMB.2.raw
  modified_base (410)..(415): a, c, t, g, unknown or other
tcagagacgcactccacgaccggtgctcgatttagtgtagtgtgaagggaaagggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtctccccctggcgccctgctccaggagcacctccgagagcacagcggccctgggctgcctggtcaaggctacttccgagtgcgtctctgagcgggctgggcaagggcgcatagnnnnnn

SEQ ID NO: 403859 - DNA, 550 bp, Homo sapiens
  misc_feature: GZ8MTXP01A3WBK.3.70.G04.1.454.CMB.2.raw
  modified_base (200)..(200): a, c, t, g, unknown or other
  modified_base (369)..(369): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagccaccctctcctgcagggccagtcagagtgttagggccattagcctggtaccagcagaaacctggccagcctcccagtctcctcatctatggagcacacaacgacgggccacgtggcatcccagccaggttcagtgcaggtcggtctgggacagacttcaccctnatcatcagccgctagacgtcctaggaacgtattttcgacttaagtttattactgtcagtcgtaggtttactcggtcgccctacgttcggccgtgggaccaaggtgattacgacaaacgacgtgtcggctcgctactacttcttcgttcttcacttccgttcccgcttactcgttaagaacg

SEQ ID NO: 403860 - DNA, 667 bp, Homo sapiens
  misc_feature: GZ8MTXP01CGEEW.3.70.G04.1.454.CMB.2.raw
  modified_base (298)..(298): a, c, t, g, unknown or other
  modified_base (387)..(387): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagcccaccctctcctgcagggccagtcagagtgttagggccatagcctggtaccagcagaaacctggccagcctcccagtctcctcatctatggancacacaacgacgggccacgtggcactccccagccaagggttccaggtcggctagggtcggggtctggggacctagaccttccaaccctnactcactcacgccgctagacgtctaggtagttatttcgagttaagttttacttacgtgtaccgtagtacgttaacgggtttaccttccggggttccggtaccccgtttaccgggtttacccgggaccccggttaacggggaaacccgttaaagggttcggtaaacttaacgtaaccgtaaaacgtacgttggtcgttactcgaacccgtaaccttgttccgtttccgttacctttccctacgtttccccgttccccgacttacgttcgttaagggtaacg

SEQ ID NO: 403861 - DNA, 662 bp, Homo sapiens
  misc_feature: GZ8MTXP01ASM2B.3.70.G04.1.454.CMB.2.raw
  modified_base (200)..(200): a, c, t, g, unknown or other
  modified_base (302)..(302): a, c, t, g, unknown or other
  modified_base (312)..(312): a, c, t, g, unknown or other
  modified_base (390)..(390): a, c, t, g, unknown or other
  modified_base (603)..(603): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagccaccctctcctgcagggccagtcagagtgttagggccacttagcctggtaccagcaagaaacctggccacgcctcccagtcctcctcatctatggancacacaacgngggccacgtggacactccccagcccaggttccaggtggcgaggtcgggtctaggggaccagtaccttaccaccccttnaattccgaacttccacggtcccgacctaagaccgccgtagaacgttattttcggacttaacggtttttatacgtcgtactaggcgttaagggtttaccttcgggtacgggccctttaacggtttccgggacccttaggggaaaccctaaagggttcgaaacttacgtaacgaaaacccgtagttgggtcggaccttcggaccaaaccccgttnttccgtttcgttaccttcctacgttccccgttacccgcttacgttccgttaacggtaag

SEQ ID NO: 403862 - DNA, 962 bp, Homo sapiens
  misc_feature: GZ8MTXP01D4A1Q.3.70.G04.1.454.CMB.2.raw
  modified_base (312)..(312): a, c, t, g, unknown or other
tcagagacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagcgtggtggagacgtgggaggaggtcttgactccgacggcccgggggtcctgacgtactctctgtgagtctcgtggttcactgtcagtagacaaactacagtacgaacgtcgggtccnccgacggccgtaccggaagggggaacggggccgggtaggtcgggtacttacgtaaagttttagtttaaggtgggtacggtaagttacggggttaaacggttaaccggttaacccgtaaccggacgtaacggtaacccgttcccgggtaacggaccggaaccggggggtaccctaaactttaccccgaaaccccgtaacttacccgtaacccgaaagggtaaacgttaaacctttaaaattttaaccgaaaaaggttaaaactttcccgggtttactaccccttttaaaccctttaaacaaaaaaacgttccggaaaaaacccctaaacccgttaacgggaaaaccgggggtaaaaaaccccggtaacgggggaaaaccccgttaaccgggggttaacccgtttaaaatttaaacgttttaaaggtttacggggtaccggtaaaccggggttaaagggtttaaaccgggttaacggggggtttaagggttaaaggttaaacgggttttcgggggtttaagggggttaaaccgggtttttaaaccggggcccggggggttacccgtttaaccgggggaaacccccgtttggggtaacccccttaacccggttcccggttacccctaaccgggttaacccggttaaccccccg

SEQ ID NO: 403863 - DNA, 614 bp, Homo sapiens
  misc_feature: GZ8MTXP01AQKZU.3.70.G04.1.454.CMB.2.raw
  modified_base (543)..(543): a, c, t, g, unknown or other
  modified_base (564)..(564): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccgaggcccgggggtcctgagactctcctgtgagtctctgggttcactgtcagtagcaactacatgaactgggtccgccaggctccgaggggaacggggccggaggtgggtctactaatttatttagtggcgtagtggtagtacgtacctacgcgagactccgtgcgcgggccgatcaccatctaccagacgactaatttcgaaagtaacttacggttcaccttaccttaacaaattcgaaaaccctaacgtcgaaacggaacccggaggaaccaccgggaccttaatagtttagttgcggtacgtagtaggtacggtggtanagtggttgggttagttaacgngggggttcccttagggaaccctggtccctacgtcttccctcgcgtccccg

SEQ ID NO: 403864 - DNA, 664 bp, Homo sapiens
  misc_feature: GZ8MTXP01CJXCC.3.70.G04.1.454.CMB.2.raw
  modified_base (201)..(201): a, c, t, g, unknown or other
  modified_base (409)..(409): a, c, t, g, unknown or other
  modified_base (644)..(644): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccgagggganacacgccaccctctcctgcagggccagtcagagtggttaggggcctacttagcctggtacccagcaagaaacctggcccagccctcccagtcctcctcatctagtggacgcaacacaacgagggcccacgtcggccactccccgagcccgtaggttccaggtcggctagggtcggggtcgtaggggactagtaccttcccaacccttnaacttcatccacgccccgactagacgtcctggaaagttactttgacgttaagtttttactaccgtagtccgagtcgttaacggggtttaccttcgggtccgggtccccgttacgtttcccgggaccccgttgggtaacccgtaaaggtcggtaactacgttaacaaaaccggaccttggtcggccttaggacctaaccgtattccgttcgttccttcctactttcccgtcccctnttacgttcgttaacggtaag

SEQ ID NO: 403865 - DNA, 580 bp, Homo sapiens
  misc_feature: GZ8MTXP01C1CHU.3.70.G04.1.454.CMB.2.raw
  modified_base (368)..(368): a, c, t, g, unknown or other
  modified_base (379)..(379): a, c, t, g, unknown or other
  modified_base (386)..(386): a, c, t, g, unknown or other
tcagagacgcactccacgaccggtgctcgatttagtgtagtgtgaagggaaagggggaggactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccattagcctggtaccagcagaaacctggccagcctcccagcctcctcatctatgagcacacaaacaggccactggcatccccagccaggttcagtggcaggtggtctgggacagacttaccaccctnatcatcagccncctagancctgaagtatttgactaagttttattactgtacagtcgtaaggggtttacttcgggtcggtaccccttaacgtttccgggccccttagggaacccaaaggtagggtattaactacgaaaacgtaaactggtcggacgttcgacgaaccctattcgttgttccttcacttccttcccgccttatccgttgtaacg

SEQ ID NO: 403866 - DNA, 744 bp, Homo sapiens
  misc_feature: GZ8MTXP01ERHG0.3.70.G04.1.454.CMB.2.raw
  modified_base (322)..(322): a, c, t, g, unknown or other
tcagagacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtgggaggaggtcttagactccgacgggtccccgggggtcctgacgactctccgtgtagtacgtctcgtggttcacgtgtacagtacgacaactacagtacgaacgtcgggtcccnccgacggccgtacggagggggaacggggccggtaggtcgggtactactaatttagtttagtgggtacgtagttgggttaacgtacgtaaccgtacgacgacgtaccgtccggtaacgcggaacgggtccgtattacccgaacctactccaccgaagtacaaacctaatttacgaaaagttacttaacggtttcaacctttaccttaaacaaagttacaaaccctaacgtacgaaaccggggaacgaacggaaccgtaccggtacttaattatttagttacggacgtacgtaaggttaggtacggggttgtaagttaggttggggttagggttaacggttaaccgggttcggggccgttaaccggggtaaccccttgggttaaccccaaccggttccttaccctcggttaaccctaacccccg

SEQ ID NO: 403867 - DNA, 692 bp, Homo sapiens
  misc_feature: GZ8MTXP01DQM4H.3.70.G04.1.454.CMB.2.raw
  modified_base (361)..(361): a, c, t, g, unknown or other
  modified_base (474)..(474): a, c, t, g, unknown or other
tcagagacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactgggaggaggcttgatccgaggcccgggggtccctgagactctcctgtgagtctcgtgggttcactgtcagtagcaactacatgaacgtcgggtcccgccgaggctaccggagggggaacggggccggaggtcgggtctactaatttagtttagngggcgagtaggtagtacgtacctacgcagacctccggtgcgcgggccgacttccacctatcctaccaagtaagtaaaactttcaaaggtaacttacgttgaccttacccttanaaaactcgaaaacctaaaccgtagggaaaccgaaacccggggagggaaccgaaccgggtaccgttaaattaactttagtggtacgacggtaaggtaggttacggggtggtaaggtaagttggggttggggttacgttaaacgggtgggggttacccgttcggggttaacccttggggtaccctaacccgttctcccgttacgcgttccccgtaacccg

SEQ ID NO: 403868 - DNA, 795 bp, Homo sapiens
  misc_feature: GZ8MTXP01BWYNL.3.70.G04.1.454.CMB.2.raw
  modified_base (373)..(373): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtgggaggaggcttgatccgacggccccgggggtcctgacgactctcctgtgaagtctcgtgggttcactgtcagtagacaactacatgaacgtcgggtcccgccgaaggcctaccggaagggggaacgggggccggaggtcgggtactacgtaaagtttagtttagngggtacgtagttagggtaacgttaaccgtacctaccggcgtacgtacctccggtagaccgaacggggccctaacttacccaccctactacctaccgaagtaacgaaacttaaactttacgaaaagttaacttaacggttcgtacctttaccttaacgaaaattacggaaaacctaaacccgtagaaaccgggggtaaacccggaaggggtaacccgtaacccggggtacgttaaattaagttttacgttacggggtgtaaccgggtaaaggtttaccgggttaagggggttaagggttaacggttaaaggtttcggggttagggggttttaacggttaaaccgggttcggggggttacccttaccgggggtaacccttggggtaaccctacccgggttcttaccccgtcgaaccgtcccccg

SEQ ID NO: 403869 - DNA, 739 bp, Homo sapiens
  misc_feature: GZ8MTXP01EN720.3.70.G04.1.454.CMB.2.raw
  modified_base (306)..(306): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagtcttgggttttccttgttgcttatttacaaaaggtgtccagtgtgaggtgcagctggtggagacgtggaggaggcttgactccgacggcccgggggtcctgacgtactctctgtagagtctcgggggtttcactgtcagtagcaatacatgacgtcggccncgacgcgacggaggggacgggcgtaggtggtctataatttattagtggtacgtagttacggttacggtacgtacgtacgacgaacgtaccgtccggtcgacggtaccgggtaccgtactacctacctactacctaccgaacgtaacgtaacttaacttaacgtaaacgtaaacgttacgttacgtacttaccttaaactaaacgtaaacgtaaaccgtaaaccgtaacggtaaaccggaaaccggaaccggtaaccgtaaccggtaaccgttaacgttaacgtttagttacggtacggtaacggtaagggttaacgggttacgggttagggttaggttaaggttagggttacggggttacggttaacgggtaaccggggtaccgggtaaccgggtaacccggttaccggttaccgtaacccgttcccgtcccg

SEQ ID NO: 403870 - DNA, 690 bp, Homo sapiens
  misc_feature: GZ8MTXP01CQJKQ.3.70.G04.1.454.CMB.2.raw
  modified_base (546)..(546): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtggaggaggcttgatccgaggcccgggggtccctgagactctcctgtgaagtctcgtgggttcactgtcagtagcaactacatgaacgtgggtcccgccgaggcgtccggagggggaacggggccggaggtgggtctacgtaaatttatttagtggacgtagtggtagtacgtacctacgcagactccgtagcgaacggggcctaagttccacctatcctaccaagacgtaactaaatttcaaaggtaacttacgttgtaccttaccttaacaaatgaaaacctaaccgtagaaacggaacccgaagggaaccacgggtaccttaattattagttacggngtcggtaagttagggtaacgggttgggttaaggttaaaggtttgggttgggggtttaaacgttaacggttcggggggttccttacgggggtaaaccccttggggttcccaaccgggttccttacccgttaaccgcgtaaccccg

SEQ ID NO: 403871 - DNA, 655 bp, Homo sapiens
  misc_feature: GZ8MTXP01A09NO.3.70.G04.1.454.CMB.2.raw
tcagagacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtgggaggaggcttgactccgaggcccgggggtcctgagactctcctgtgagtctcgtgggtcactgtcagtagcaactacatgaacgtcgggtcccgccgaggccgtccggaagggggaacggggccggaggtcgggtctacgtaatttagtttagtgggcgtagtggtagtacgtacctacgcagaccgtccgtgcgcgggcctattccgaccatctaccagtacgactaatttacaaagtacttacgttgaccttactactaaagtcaaacctaacgtagaacgggtaacccggaggaccgaccggtacgttaatagtttgtagtgtacgtaagttcggtagggtggtaagttaggttgggttgggttacgttaacgggcggggttccgttacggggaacccttgggtcccgtacccgttcttacccgtaaccgcggtaacccccg

SEQ ID NO: 403872 - DNA, 688 bp, Homo sapiens
  misc_feature: GZ8MTXP01CHGW7.3.70.G04.1.454.CMB.2.raw
tcagagacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccgacggcccgggggtcctgacgactctctgtgagtctcgtgggtcactgtcagtagacaactacatcgaacgtcgggtcccgccgaggctccggagggggaacggggccggaggtgggtctacgtaatttatttagcggtcgagttggtagtacgtacccgtacgcacgactccggtgcgaagggcccgtattccacctatcctaccgagacgtaactaaactttacgaaaagtactaccgtttcgacctttaccttaacaaaagttcgaaaacctaacccgtaggaaacgggaaacccggtaaggaacccgtaaccggtaccgtttaaagttacgtttaagtttggacgtacggtaaggttcggtaacgggtggtagttaagttcgggttaggggttagtacggttcgggggttccttcgggggaacccttgggtccacccgttcgttcctccgttaacgtcccc

SEQ ID NO: 403873 - DNA, 645 bp, Homo sapiens
  misc_feature: GZ8MTXP01BBN45.3.70.G04.1.454.CMB.2.raw
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagcccaccctgtctttcgtccccgaggggagacacgcccaccctctcctgcgagggccagtcagagtggttaggggccacttagccgtggtaccagcagaaacctggcccagccctcccagtcctcctcatctagtggagcacacaacgacgggccactggcactccccagccaggttcaggtggctaggtcgggtcgtggggacacgacttcccgaccctcactcactcgagccccgtctagacgccgtaggtaagtattttgacttagtttacttactgtctagcgtagggttaccttcgggtcggtccccgtacgttcccggtacccgtcggggtaacctaaagggttacggataacgtacctaaaacgtaaccgttggtacggttcgacgacctaccgtaatttcccgttggtttccctttcctaacctttcccgtttccccgacccgttaccgtccgttcggtaaggg

SEQ ID NO: 403874 - DNA, 832 bp, Homo sapiens
  misc_feature: GZ8MTXP01DQUHQ.3.70.G04.1.454.CMB.2.raw
  modified_base (295)..(295): a, c, t, g, unknown or other
  modified_base (320)..(320): a, c, t, g, unknown or other
  modified_base (379)..(379): a, c, t, g, unknown or other
tcagagacgcactccacgaccggtgctcgatttagtgtagtgtgaagggaaagggggggagaggagcccaccactgggattccgaggtgtttccattcggtgatcagcactgaacacagaggactcaccatggtagttttggctgagtcttgggttttccttgttgtcttattttacaaaaggtgtccagtgtgaggtgcagctggtggagacgtggaggaggtcttgacgtccgacgggccccgggggtcctgacgtactctccgtgtgtagtctcgtggtcacgtgtcagtanacaatacatacgaacgtcgggtccnccgaggcctaccggagggggacggggcggaggtcggtactacgtaagtttacgtttagngggtacgtagttaggtaagttaccgtaccctacggtacgacgtaccctccgtaacggaccgaacggggtccctaacttacccgacctacttaccctacgaaacggtaacttaaccttaaaagtttcccgaaaaaaggtttctttaaacccgggttctaccctttaacccggtttaaacaaaaacgttaaacccgaaaccgtaaaccgttcgggaaaccgggaaaccccggggttggaaacccctaccggggttactttaagttaagttttaagtcggggtaaccggtagggttaagttaacccggggttaggggttaaggttaagaggttttcgggggagggttttaaaccggtaaccgggttccgggggttcccgtttaaaaccgggggtccccgttttcggaacctttaacccccgggtcttaccccgttccgaaaccggttcccccccgg

SEQ ID NO: 403875 - DNA, 467 bp, Homo sapiens
  misc_feature: GZ8MTXP01C4U98.3.70.G04.1.454.CMB.2.raw
  modified_base (165)..(165): a, c, t, g, unknown or other
  modified_base (226)..(226): a, c, t, g, unknown or other
  modified_base (307)..(307): a, c, t, g, unknown or other
  modified_base (312)..(312): a, c, t, g, unknown or other
  modified_base (339)..(339): a, c, t, g, unknown or other
  modified_base (447)..(447): a, c, t, g, unknown or other
  modified_base (453)..(467): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttnaaatgaacaacctgagaaccgaggacacggcgtatattattgtgcgagtagtaggtggtanaagtggtgggtgttaacgtggggcctgggaccctggtccaccgtctcctcacgcctccacgaggcccatccgtcctccccnggccncctgcctcaggacgcaccgtccgagancacgacgcccggccgtcgggctcggccgtggaccgaaacggtaccttaccgtcgtacggtcgtaccgttctcgtggacgggccggggtactcggggacaacgggccanagtagnnnnnnnnnnnnnnn

SEQ ID NO: 403876 - DNA, 576 bp, Homo sapiens
  misc_feature: GZ8MTXP01AW556.3.70.G04.1.454.CMB.2.raw
  modified_base (200)..(200): a, c, t, g, unknown or other
  modified_base (216)..(216): a, c, t, g, unknown or other
  modified_base (288)..(288): a, c, t, g, unknown or other
  modified_base (299)..(299): a, c, t, g, unknown or other
  modified_base (403)..(403): a, c, t, g, unknown or other
  modified_base (557)..(557): a, c, t, g, unknown or other
  modified_base (564)..(564): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttcgtcccagggganacagccaccctctccngcagggccagtcagagtgttagggccacttagcctggtaccagcagaaacctggaccagcctccagtctccncatctatgganccacaacaacgagggtccaacgtggacaactccccgaagtcccgtaggttccaaggtcggactaggtcggggtactaggggactaggacctttcgaaccccttntactcactcgacgccgactacgactcgtagtattagttcgattagttactctgacagtcgtacgttctcggtcgtcctacgttcggaccgtggactaggtagtagtatacaacgaaagtctggcgcttcgactacttcgttcttcgtaacttcnccttccnccgctcttcgtg

SEQ ID NO: 403877 - DNA, 416 bp, Homo sapiens
  misc_feature: GZ8MTXP02JRH2A.3.70.G04.1.454.CMB.2.raw
  modified_base (383)..(383): a, c, t, g, unknown or other
  modified_base (410)..(416): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactgggggcctgggaaccctgggtcaccgtctcctcagccctccaccaaggcccatcggtctccccctggcgccctgctccaggagcacctccgagagcacagcggccctgggctgcctggtcaaggctactccgagtgcgtntctgagcgggctggcaagggcgcatgnnnnnnn

SEQ ID NO: 403878 - DNA, 596 bp, Homo sapiens
  misc_feature: GZ8MTXP02GSW4G.3.70.G04.1.454.CMB.2.raw
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccacttagcctggtaccagcagaacctggccagcctcccagtctcctcatctatggagcacacaacagggccactggcatcccagccaggttcagtgcagtcgggtctgggacagacttcaccctcatcatcagccgcctagacgcctagaagtattttgctagtttactactgtacagtctagggtttacttcgtcggtccctacgtttccgggcccttaggggaaccctaaaggtcggaatacgtaaccgaaaacgtaacgttaggtacgggactcggaccaaacccgtattaccctggttccttaacgtaactttccctttacccccggcctaacttcccgttaggtaaccgg

SEQ ID NO: 403879 - DNA, 578 bp, Homo sapiens
  misc_feature: GZ8MTXP02I5Y7X.3.70.G04.1.454.CMB.2.raw
  modified_base (297)..(297): a, c, t, g, unknown or other
tcagagacgcactccacgaccggtgctcgatttagtgtagtgtgaagggaaagggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccgggggtccctgagactctcctgtgaagtctctggggttcactgtcagtagcaactacatgaactgggtccnccaggctccgaggggaaggggccggagtgggtctcaatttatttatggcgatggtagtacgtactacgcagactccgtgcaggggccattcaccatctccagagacaatttcaagtaaatacgttgctccttacaaatgaaactaacctgaacgaaccgagacacggcctatattatgtgcgagtagtacggtggtgaatggtagggttgttaacgtcgggggcccttagggggaaaccccttggggtaccacccgggttctacccgttcgaacggtcccc

SEQ ID NO: 403880 - DNA, 587 bp, Homo sapiens
  misc_feature: GZ8MTXP02F08W8.3.70.G04.1.454.CMB.2.raw
  modified_base (460)..(460): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccaggcccggggggtcctgagactctcctgtgaagtctctgggttcactgtcagtagcaaatacatgaactgggtccgccaggctccgaggggaaggggccggagtgggtctcaatttatttagtggcgatggtagtacgtactacgcagactccgtgcgaggggccattcaccatctccagacactaattcaaagatacgttgccttacttacaaatgaaacaacctgaagaaacccgnggaccacgggctaatattatgtgtgagtaggtcggtggtagaattgggtgggtacgtttaaacgcgggggtcccttaggggaaaccccgttgggtaccctacccggttcttcccacgtacgtccccc

SEQ ID NO: 403881 - DNA, 572 bp, Homo sapiens
  misc_feature: GZ8MTXP02IR3VO.3.70.G04.1.454.CMB.2.raw
  modified_base (299)..(299): a, c, t, g, unknown or other
  modified_base (382)..(382): a, c, t, g, unknown or other
  modified_base (441)..(441): a, c, t, g, unknown or other
  modified_base (480)..(480): a, c, t, g, unknown or other
  modified_base (558)..(558): a, c, t, g, unknown or other
tcagagacgcactccacgaccggtgctcgatttagtgtagtgtgaagggaaagggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactgggaggaggcttgatccaggcccgggggtccctgagactctcctgtgaagtctctgggttcactgtcagtagcaactacatgaactggggtccnccaggcctccgaggggaaggggccggaggtgggtctcaatttatttatggcgatggtagtacgtacctacgcagactcgtgcnggggccattccacccatctaccagaagaaaatttcaaagaaatacgttgcttcccttanaaatgaaacactgaagaaccgaggacacggcgtatattntgtgcgagtagtacggtggtagaagttggtggggttagttaaacgtgggggcctggggaaccctggtccaccgtctcncacgtccctacccg

SEQ ID NO: 403882 - DNA, 556 bp, Homo sapiens
  misc_feature: GZ8MTXP02IVCX1.3.70.G04.1.454.CMB.2.raw
  modified_base (301)..(301): a, c, t, g, unknown or other
  modified_base (373)..(373): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtcctcctcatctatggancacacaacagggcccactggcatccccagccaggttcagtggcagtcgggtctgggacagacttccaccctnatcatccacgcccgacctagacgcctagaagtatttgactagtttattactgtcagtctagggtttacttcgtcggtccctacgtttccggccctgggacctaaaggtggaatatacgaaacgtactagtcggactcgacacgtactctgttcttcgtacttttcccgctacttctgtagtcg

SEQ ID NO: 403883 - DNA, 532 bp, Homo sapiens
  misc_feature: GZ8MTXP02H0A7B.3.70.G04.1.454.CMB.2.raw
  modified_base (365)..(365): a, c, t, g, unknown or other
  modified_base (376)..(376): a, c, t, g, unknown or other
  modified_base (510)..(510): a, c, t, g, unknown or other
tcagagacgcactccacgaccggtgctcgatttagtgtagtgtgaagggaaaggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacaggccactggcatcccagccaggttcagtggcagtggtctgggacagacttcaccctnatcatcagccnctagacgcctgagtatttgcttagtttatactgtcagctagggtttacttctcgggtccctacgtttccgggcccttaggggaacctaaaggtcggatactacaaaacgactgtaggctcgcacatctgtcttnactcttcccgctactctagacg

SEQ ID NO: 403884 - DNA, 618 bp, Homo sapiens
  misc_feature: GZ8MTXP02FMNLP.3.70.G04.1.454.CMB.2.raw
  modified_base (298)..(298): a, c, t, g, unknown or other
  modified_base (364)..(364): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccattagcctggtaccagcagaaacctggccagcctcccagtctcctcatctatggancacacaacagggccactggcatcccagccaggttcagtgcagtcggtctgggacagacttcacctnatcatcagccgctagacgcctgaagtatttgcttagtttattactgtacagcgtagggttacttcgtcgggtccctacgtttccgggcccgttacggggaaccctaaaggtcgggtaaactacgtaaccgtaaaacggaaaccgttggtacggaccgttacggaccctaaccgtaacttcccgttacggtttacccttaaccgttaaccgtttcccctttacccccggaccctaacttcccgttaggtaaacgg

SEQ ID NO: 403885 - DNA, 582 bp, Homo sapiens
  misc_feature: GZ8MTXP02GUBHJ.3.70.G04.1.454.CMB.2.raw
  modified_base (301)..(301): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccacttagcctggtaccagcagaaacctggccagcctcccagtcctcctcatctatggacncacacaacagggccactggcactcccagccaggttcagtgcagtcgggtctgggacagtacttcaccctcatcatcagccgcctagacgcctagaacgtattttgacttaagtttacttactgtacagtcgtagggttacttcgtcgtccctacgtttccggcccgtaggaaccgaaaggtggtaactacgtaaccgaaaacgtactaggtacggtcttacggaccaccgtactccgtagtccttaactacttccgttacccgcctactccgttagaacgg

SEQ ID NO: 403886 - DNA, 572 bp, Homo sapiens
  misc_feature: GZ8MTXP02GSTHI.3.70.G04.1.454.CMB.2.raw
  modified_base (200)..(200): a, c, t, g, unknown or other
  modified_base (299)..(299): a, c, t, g, unknown or other
  modified_base (368)..(368): a, c, t, g, unknown or other
  modified_base (379)..(379): a, c, t, g, unknown or other
  modified_base (384)..(384): a, c, t, g, unknown or other
  modified_base (393)..(393): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagccaccctctcctgcagggccagtcagagtgttaggggccacttagcctggtaccagcagaacctggccagcctcccagtctcctcatctatggancacacaacgagggccactggcatccccagccaggttcagtgcagtcgggtctgggacagacttcacctnatcatcagccnctagncctagagtntttgactagtttatactgtcagtcgtagggtttacttcgtcggtccctacgtttcccgggcccttacggggaacctaaaggttgggaatagtaccaaaacgtaacgttacggtggcctacggacctaccgtacttcctgttccttctaccttccttccccgactacttccgtagtacgg

SEQ ID NO: 403887 - DNA, 415 bp, Homo sapiens
  misc_feature: GZ8MTXP02FSWSE.3.70.G04.1.454.CMB.2.raw
  modified_base (412)..(415): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgcccctgctccaggagcacctccgagagcacagcggccctggggctgcctggtcaaggactacttcgagtgcgtctctgagcgggctggcaaggcgcatagnnnn

SEQ ID NO: 403888 - DNA, 581 bp, Homo sapiens
  misc_feature: GZ8MTXP02GK6RY.3.70.G04.1.454.CMB.2.raw
  modified_base (200)..(200): a, c, t, g, unknown or other
  modified_base (300)..(300): a, c, t, g, unknown or other
  modified_base (393)..(393): a, c, t, g, unknown or other
  modified_base (557)..(557): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagccaccctctcctgcagggccagtcagagtgttaggggccacttagcctggtaccagcagaaacctggccagcctcccagtctcctcatctatggancacacaacgacgggccactggcactccccagccaggttcagtggcaggtcggggtctggggacagtacttccacccttcatcatccacgcccnctagacgcctagaacgttattttgacttaagtttacttacttcggtcaagtccgtaaggggtttacttcgtcgggtaccctacgtttccgggcccttacgggaacctaaaggtcgaacttaatacgaaaacgtacgtgtacgctacgcactacgtctcgtctcncttccttcccgactatcgagtacg

SEQ ID NO: 403889 - DNA, 574 bp, Homo sapiens
  misc_feature: GZ8MTXP02JZMAY.3.70.G04.1.454.CMB.2.raw
  modified_base (380)..(380): a, c, t, g, unknown or other
tcagagacgcactccacgaccggtgctcgatttagtgtagtgtgaagggaaagggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccaggcccggggggtccctgagactctcctgtgaagtctctgggttcactgtcagtagcaactacatgaactgggtcccgccaggctccgaggggaacggggccggagtgggtctcaatttattatggcgatggtagtacgtacctacgcagactcgtgcnggggccattccacatctccagagactaatttcaaagaattacgttgccttaccttacaaaatcgaaacaacctgaacgaaccgaggacacgggctatattatgtgcgtagtagtacggtggtagaatggttagggtcgttaacgtcgggggcctaggggaacccctgggtccaccggttcctcctcacgtcccc

SEQ ID NO: 403890 - DNA, 605 bp, Homo sapiens
  misc_feature: GZ8MTXP02H8OJD.3.70.G04.1.454.CMB.2.raw
  modified_base (301)..(301): a, c, t, g, unknown or other
  modified_base (376)..(376): a, c, t, g, unknown or other
  modified_base (404)..(404): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagcccaccctctcctgcagggccagtcagagtgttaggggccattagcctggtaccagcagaaacctggccagcctcccagtcctcctcatctatggancacacaacgagggccacgtggcactccccagccaggttcagtggcaggtcgggctggggacagtacttcaccctnatcatcagcccgctagacgccagaagtntttgcttagttttatacgtgtcagcgtagggtttaccttcgtcggtaccctacgtttcccgggacccgttaggggaaccctaaaagggtcggtaacttaacgtaccgaaaacgtaacgttggacggtcctacgaccgaactcttccgttacgttccttaaccgtacttccccgtcccgtacctacgttccgttaggaacgg

SEQ ID NO: 403891 - DNA, 615 bp, Homo sapiens
  misc_feature: GZ8MTXP02JIFQ9.3.70.G04.1.454.CMB.2.raw
  modified_base (201)..(201): a, c, t, g, unknown or other
  modified_base (305)..(305): a, c, t, g, unknown or other
  modified_base (388)..(388): a, c, t, g, unknown or other
  modified_base (400)..(400): a, c, t, g, unknown or other
  modified_base (406)..(406): a, c, t, g, unknown or other
  modified_base (416)..(416): a, c, t, g, unknown or other
  modified_base (579)..(579): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttcgtccccagggganacagccaccctctcctgcagggccagtcagagtggttagggccacttagcctggtaccagcaagaaacctggccagccctcccagtcctcctcatctagtggancacacaacgacgggccagtcggcactccccagccgtaggttcaggtcgacgtaggtcgggtcgtagggacagtacttcacctnactcatcagccnctagcnctagaagttntttgacttagtttactacgtgtacacgtcgttagggttactttcggacggtaccccttacggtttcccgggacccgttaacggggaaaccctaaagggttcggaaacttaacggaaccgtaaaacgtacgttggtacggtcctacgacctaccgtattccgtnttacctcgacttcccgtcccgactacgtcgagtacg

SEQ ID NO: 403892 - DNA, 553 bp, Homo sapiens
  misc_feature: GZ8MTXP02IWS8G.3.70.G04.1.454.CMB.2.raw
  modified_base (200)..(200): a, c, t, g, unknown or other
  modified_base (286)..(286): a, c, t, g, unknown or other
  modified_base (296)..(296): a, c, t, g, unknown or other
  modified_base (299)..(299): a, c, t, g, unknown or other
  modified_base (343)..(343): a, c, t, g, unknown or other
  modified_base (357)..(357): a, c, t, g, unknown or other
  modified_base (375)..(375): a, c, t, g, unknown or other
  modified_base (541)..(541): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagtcaccctctcctgcagggccagtcagagtgttagggccattagcctggtaccagcagaaacctggccagcctccagtctccnatctatggancanacaacaggccatggcatcccagccaggttcagtgcagtcggtcnggacagctcacctnatcatcagccgctagacncctagaacgtattttgacttagtttacttacgtcgttacagtctaaggggtttaccttcgttacggtccctactttccggcccctagggacccaaagttcggatacgtacaaaacgtactgtaggactcggacaaccattcctgttacttctacttccttaccccnctactcgacgag

SEQ ID NO: 403893 - DNA, 414 bp, Homo sapiens
  misc_feature: GZ8MTXP02G0JLA.3.70.G04.1.454.CMB.2.raw
  modified_base (411)..(414): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaaggcccatcggtctccccctggcgccctgctccaggagcacctccgagagcacagcggccctgggctgcctggtcaaggactacttccgagtgcgtctctgagcgggctgggcaagggcgcatagnnnn

SEQ ID NO: 403894 - DNA, 646 bp, Homo sapiens
  misc_feature: GZ8MTXP02JA7XW.3.70.G04.1.454.CMB.2.raw
  modified_base (202)..(202): a, c, t, g, unknown or other
  modified_base (301)..(301): a, c, t, g, unknown or other
  modified_base (614)..(614): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttcgtccccgagggganacagcccaccctctcctgcagggccagtcagagtgttagggccattagcctggtaccagcaagaacctggccagcctccagtctcctcatctatggacncaacacaacgagggccagtcggacactccccaggtccaggttcaggtcggcgaggttcggggtactcggggaacacgtaccttccaccctcaatccactccgacgcccgtaccgtaggaccgtcccgtagtaaacgttcttttacggacttaagtttttactacgttcgttaccgaggtacgttaacgggtttaccctttcggtacccggtaccccctacgttttacccgggaccgttacggggaacccttaaaagggtggaaacttaacgtacgaaaacgtagtggtacgctacggacacgttacttccgtnttacctcgtactcctccctatctacgtagacg

SEQ ID NO: 403895 - DNA, 702 bp, Homo sapiens
  misc_feature: GZ8MTXP02GDPRS.3.70.G04.1.454.CMB.2.raw
  modified_base (360)..(360): a, c, t, g, unknown or other
  modified_base (397)..(397): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtgggaggaggcttgatccgacggcccggggggtcctgagactctctgtgagtctgtggttcactgtcagtagacaactacatagaacgtcgggtcccgccgaggccgtaccgagggggaacggggccggaggtgggtctacgtaatttattagnggtcgtagtggtacgtacgtacctacgcagacctcgngcgcggggccgattaccgacctacgtctacgaacgtaagaacttaattacgaaaagtacttacgttacaccctttaccttaaacaaaattacgaaaacctaaaccgtacggaaacggtaaaccggacgggaacctacggggtaccctaattaagttagttaggtacggacgtaagggttaaccgggttagggtaggtagtaaaggtgggtttaaggggtactttaaccggggcggggttacccggtaacggggtaacccgttcggtaccccgtaccggttcctacccgtacgaccgtaacccccg

SEQ ID NO: 403896 - DNA, 617 bp, Homo sapiens
  misc_feature: GZ8MTXP02J288S.3.70.G04.1.454.CMB.2.raw
  modified_base (326)..(326): a, c, t, g, unknown or other
  modified_base (340)..(340): a, c, t, g, unknown or other
  modified_base (364)..(364): a, c, t, g, unknown or other
  modified_base (380)..(380): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccgaggcccggggggtccctgagactctcctgtgaagtctctgggttcactgtcagtagcaaactacatgaactgggtccgcaggctccgaggggagggccggagnggtctatattattnggcgatggtagtacgtacctacgnacgtactccggtgcgnggggccaattccacctatcctaccagaacgtaactaaactttcgaaaagtaacgttacgttgaccttaccttacaaaattcgaaaacaaacccgtgaaacgaaccggaggaaccaccggggtaccttaaatacgtttaagtggtcgacgtaaggtacggtacgggtgtagaagtggggtaggttacgtacgtggggaccgttagggaacccttggccacggtctccgtcacgtcccc

SEQ ID NO: 403897 - DNA, 607 bp, Homo sapiens
  misc_feature: GZ8MTXP02ICUBY.3.70.G04.1.454.CMB.2.raw
  modified_base (389)..(389): a, c, t, g, unknown or other
  modified_base (411)..(411): a, c, t, g, unknown or other
  modified_base (473)..(473): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactgggaggaggcttgatccgaggcccggggggtcctgagactctcctgtgaagtctctgggttcactgtcagtagcaactacatgaacgtgggtccgccaggctaccgaggggaagggccggaggtgggtctactaatttatttagtggcgtaagtggtagtacgtacctacgcagactcgtgcngggcctatccacactctcaganactaatttacaaagtaatacgttgccttacttacaaatcgaaacaacctgaaacgaaaccgnggacacgggtactaatagttatgtcgacgtagtaggtacggtggtagaagtggtagggtacgttaacggcggggtacctagggggaaccccttggggtaccctacccggttccttcccgtacgaccgtaccccg

SEQ ID NO: 403898 - DNA, 419 bp, Homo sapiens
  misc_feature: GZ8MTXP02F5LF7.3.70.G04.1.454.CMB.2.raw
  modified_base (416)..(419): a, c, t, g, unknown or other
tcagagacgcactccacgaccggtgctcgatttagtgtagtgtgaagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagccctccaccaagggcccatcggtcttccccctggccgccctgctccaggagcacctccgagagcacagcggccctggggctgcctggtcaacggacctacttccgagtgccgtctctgagcgggctggcaaggcgcatagnnnn

SEQ ID NO: 403899 - DNA, 629 bp, Homo sapiens
  misc_feature: GZ8MTXP02HI3TL.3.70.G04.1.454.CMB.2.raw
  modified_base (343)..(343): a, c, t, g, unknown or other
  modified_base (355)..(355): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtggaggaggcttgatcccgaggcccggggggtccctgacgactctcctgtgaagtctcgtggttcactgtcagtagcaaactacatgaacgtgggtccgccaggctaccgaggggaacggggccggagtgggtctanaatttatttagnggacgtatggtacgtacgtaccgtacgcagtacctcgtgcgcggggccattccaccatccgtaccaagacgtaactaaatttacgaaagtaaattacgtgtacctacttacaaaatcgaaacaaccgtagaacgaaccgagaccacgggtactataattagtgtgacgtaagttagtacggttaggagtaagtggttaggggtacgttaacgggcggggtacccttagggggaaccccttgggtacccaccggttctcccgtacgacgtccccg

SEQ ID NO: 403900 - DNA, 710 bp, Homo sapiens
  misc_feature: GZ8MTXP02JNC96.3.70.G04.1.454.CMB.2.raw
  modified_base (503)..(503): a, c, t, g, unknown or other
  modified_base (589)..(589): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagcttgggttttccttgttgctatttcaaaaggtgtccagtgtgaggtgcagctggtggagacgtggaggaggcttgatccgaggcccgggggtccctgagactctcctgtgaagtctcgtgggtcactgtcagtagacaactacatagaacgtcgggtcccgccgaggcctaccggaagggggtaacggggccggaggttcggggtctacgtaaatttagtttagtggacgtagttagggtaacgtacgtaccgtacgacgacgaccgtccgtgccgacgggggtccatttcccgaacctaattccgtacccaaggtaacgtaacctaaaattttccgaaaagtaacttaaccggttancccttaccttaacgaaaattcgaaaacctaaccgtagaaacgaaacccggagaaccgtaccgggtaccttaattaacttagttggngacggtaagttaggtacgggttaggtagttaaacggttggtagggggttactttaacgggcgggggtacctacggggtaacccgttggtacccgaccggttcctcccgtacaccggtcccc

SEQ ID NO: 403901 - DNA, 583 bp, Homo sapiens
  misc_feature: GZ8MTXP02G0E8W.3.70.G04.1.454.CMB.2.raw
  modified_base (200)..(200): a, c, t, g, unknown or other
  modified_base (286)..(286): a, c, t, g, unknown or other
  modified_base (297)..(297): a, c, t, g, unknown or other
  modified_base (397)..(397): a, c, t, g, unknown or other
  modified_base (550)..(550): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagccaccctctcctgcagggccagtcagagtgttagggccattagcctggtaccagcagaacctggccagcctcccagtctccncatctatggancaacacaacgaggccatggcactccagccaggttcagtgcaggtcggtcgtgggacagtacttccacctcatcatcacgccgactagcgcctagaagttntttgacttagtttagttaactcgtacagtcgttacgggtttaccttgtaccggtcctacgtttccggacccgtacggaaccaaaggtgaacttagaaccgtaaacgtaacttggacggtctacgacctaacctactcgtacgttaccttaacncgtttaccccttacccgactactttcgacgtag

SEQ ID NO: 403902 - DNA, 580 bp, Homo sapiens
  misc_feature: GZ8MTXP02GHL8U.3.70.G04.1.454.CMB.2.raw
  modified_base (200)..(200): a, c, t, g, unknown or other
  modified_base (298)..(298): a, c, t, g, unknown or other
  modified_base (376)..(376): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccagggganacagccaccctctcctgcagggccagtcagagtgttagggccattagcctggtaccagcagaacctggccagcctcccagtcctcctcatctatggancacacaacgagggtcccagtggcactccccagcccaggttccaggtggcaggtcgggtctgggacagcttccaccctnatccatccagcccgctagacgcctagtaacgtatttgacttagtttattacgtgtacagtctaacggggtttactcgtcggtacccctacgtttcccgggcccgttacgggaacctaaaggtcggtaatacgtaacaaaacggtactaggtacggtcacgacacctatctcgttctcgtactccttcccgccattccgagtacg

SEQ ID NO: 403903 - DNA, 457 bp, Homo sapiens
  misc_feature: GZ8MTXP02GYU34.3.70.G04.1.454.CMB.2.raw
  modified_base (342)..(342): a, c, t, g, unknown or other
  modified_base (449)..(457): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatggtgggtgttaacgtggggcctgggaaccctggtcaccgtctcctcacgccctccaccgaagggccccagtccggtccttccccccgtggcccgcccctgcctccgaggacnccaccctccgagacgcacaggccggcccgtgggctgcctggtcaaccggtactacgttccgagtcgccgtctcgtgacggcgggcgtgggacaagggcgacagtagnnnnnnnnn

SEQ ID NO: 403904 - DNA, 1048 bp, Homo sapiens
  misc_feature: GZ8MTXP02JHO6Y.3.70.G04.1.454.CMB.2.raw
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccgaggcccggggggtcctgagactctcctgtgagtctctgggttcactgtcagtagcaaactacatagaacgtcgggtccgccgaggcctaccgaggggaaaacggggccggaaggtcggggtctacgtaaatttaagtttagtgggtacgtagttggggtaaacgttaaccggttaacccgttaacccggaccgtaaacggtaacccgttcccgggttacggaccggacggggggtcccccgtaaacgttttaccccgaaacccctaacgtttaccccgttaacccgtaaacgggaaaccgttaaaaccctaaaattttttaacccgaaaaaagggttaaaaccgttttaaacccggggttttcgaccccgtttttaaaccccctttaaaccggtaaaaaaaactttacccggggaaaaaaaacccccttaaaaaccccggtttaacggggtaaaaaacccgggtaaaaaccccccggggtaaaagggggaaaacccccggtaaaccccgggggttaaacccccggttttaaaaaatttaaacggttttttaaaacggttttcgggggttaaacggtaaaccccgggggtttaaaagggggtttaaaaccggggtttaaaacccgggggtttacgggggtttaaaacgggtaaaaaggttttccggggggtttaggggggtttaaaacgggtttttaaaacccggggtccgggggggggttaccccctttaaaggggggtaaaacccccccgttttgggggtaaccccggttaaacccccgggtttcccttaccccgtttacccggaaccggtttaacccccccgg

SEQ ID NO: 403905 - DNA, 668 bp, Homo sapiens
  misc_feature: GZ8MTXP02JPXP2.3.70.G04.1.454.CMB.2.raw
  modified_base (362)..(362): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactgggaggaggcttgatccgaggccccggggggtccctgagactctcctgtgaagtctcgtgggttcactgtcagtagcaactacatcgaacgtgggtcccgccgaggcctaccgaggggaacggggccggaggtgggtctacgtaatttagtttagnggcgtaagttgggtaacgtacgtaccctacggcacgtacgtccgtgacgcggggcctagttccaccgtatcctacccaagaacgtacctaaagtttaccaaagtaaacttacgttcgtaccttcccttaaacgaaatcggaaaacctaaccgtgaaacgaaccggaggaccacgggtacctaatacgtttatggtcgcggtaagtacgtacgggtaggtagtacgttgggtggggttacttaacgggtcggggtccggtacgggtaaacccgtggtaccacccggttctcccgtacgaccgtcccc

SEQ ID NO: 403906 - DNA, 627 bp, Homo sapiens
  misc_feature: GZ8MTXP02HNJX1.3.70.G04.1.454.CMB.2.raw
  modified_base (302)..(302): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagccctcccagtcctcctcatctatggancacacaacgagggccactggcactcccagccaggttcaggtggctaggtcgggtctggggacaggtacttccaccctcatcaatccacgcccgctagacgcctagaagtattttggcttagtttattactgtacagcagtcgtaagcgtaacgtcggaccttccgtaccgtacccggtttcgggacggggtaacgggacccgtaaaggggtcgggaacgtaacgttaaccgaaaacggtaaccgttgggttacggaccgttcggaacctaaccgtaacgtttccgttacggtttccttacgtacctttcccgtttaccccgaccg

SEQ ID NO: 403907 - DNA, 647 bp, Homo sapiens
  misc_feature: GZ8MTXP02IK04Q.3.70.G04.1.454.CMB.2.raw
  modified_base (402)..(402): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagcttgggttttccttgttgctattttacaaaaggtgtccagtgtgaggtgcagctgggtggagacgtgggaggaggcttgatcccgacgggccccggggggtccctggagactctcctgtgaagtctcgttgggttcactgtcagtagcaaactacatagaactggggtcccgccgaggcctaccggagggggaacggggccggaggtcggggtctactaatttatttagtggacgagttggtagtacgtacctacgnagactccgtgcaggggccattcaccatctaccagacgataagttacaagtaaatcgttgccttacttacaaatacgaactaaacctaggaaacgaacccggaggaccacgggtacctaattacttagttgagacggtagtaaggtacggttaggtagaaagttggggtagggttagttaacgggtcgggggtaccgttacggggaacccgttggtacctaccggtccctctaccgactacccccg

SEQ ID NO: 403908 - DNA, 651 bp, Homo sapiens
  misc_feature: GZ8MTXP02I1GLW.3.70.G04.1.454.CMB.2.raw
  modified_base (424)..(424): a, c, t, g, unknown or other
  modified_base (497)..(497): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagacgtggaggaggtcttgactccgacgggcccggggtcctgacgtactctcgtgtagagtctccgtggtcacgtgtacagtacgactaaactacagtacgaacgtcgggcccacgacggtccgtaccggaagggggaaccggggccggtaggtcgggtactacgtaaagtttattaggtcggagtaagtggtaacgtacgtaccgtacgcacgtacctccgngacgcgggactactcactatcacgagaacacttaaagttacaaagtaaacgttcgtctaccttaccttaaaanaaagtaccgaaaacctaacgcggaaacgaaaccggagaccgtacggtaacttaattagtagtgacgtacgtaaggtagtcggtagtagtaggtggtaggttaccgtcgggaccggtcaacggaactcggacctacgtctacctcgacctacccg

SEQ ID NO: 403909 - DNA, 583 bp, Homo sapiens
  misc_feature: GZ8MTXP02IUYZB.3.70.G04.1.454.CMB.2.raw
  modified_base (262)..(262): a, c, t, g, unknown or other
  modified_base (310)..(310): a, c, t, g, unknown or other
  modified_base (350)..(350): a, c, t, g, unknown or other
  modified_base (391)..(391): a, c, t, g, unknown or other
  modified_base (416)..(416): a, c, t, g, unknown or other
  modified_base (424)..(424): a, c, t, g, unknown or other
  modified_base (447)..(447): a, c, t, g, unknown or other
tcagagacgcactccacgaccggtgctcgatttagtgtagtgtgaagggaaaggggggagaggagcccaccactgggattccgaggtgtttccattcggtgatcagcactgaacacagaggactcaccatggagtttgggctgagctgggttttccttgttgttattttacaaggtgtccagtgtgaggtgcacctgggtggagtcgtgggggagcttggtccagcctgggagggtccctaagactctcctgtgcagccctntggactcaccttcacgctcaatggcctactacgtggactggggtcccnccgaggctccgaggggaagggctggacgtgggtgccgttntagagacaacaactaaacagtcgacaccgcaacaatacgcngtctgagaaaggcaagacttcaacntctcaagngatgatcagaagactcaatttanctagacaaatgaaactgaccctgaaacggaaccgacgtaaacgcccgggaccttactatttactggtacgtacaactaacggaccttaaggaactaacgaaccggaacgggttcgtaaccgtggtttacctcgggg

SEQ ID NO: 403910 - DNA, 586 bp, Homo sapiens
  misc_feature: GZ8MTXP02HFC9B.3.70.G04.1.454.CMB.2.raw
  modified_base (258)..(258): a, c, t, g, unknown or other
  modified_base (293)..(293): a, c, t, g, unknown or other
  modified_base (301)..(301): a, c, t, g, unknown or other
  modified_base (364)..(364): a, c, t, g, unknown or other
  modified_base (371)..(371): a, c, t, g, unknown or other
  modified_base (402)..(402): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggacacacgccaccctctcctgcagggccagtcagagtgttagggccattagcctggtaccngcagaactggcagcctccagtctctcatctatggncacacacncggccatgcatccagccagttcagtgcgtagtcgggtctggggacacgtacttccgacccttnactcacncgacgtccgacgtacgacgctaagtacgttntttagactttaagtttactagtcgtacgagtcgttacggttcgttacgtccggttccttaccgttcggaccgtacggaacgtaaggtcgtaactacgtaacgaacgtacgttacggtacggtactacgacctactacgttctcgttactcgtaccgttccgttaccctactacgtccgtagtcg

SEQ ID NO: 403911 - DNA, 642 bp, Homo sapiens
  misc_feature: GZ8MTXP02INKZK.3.70.G04.1.454.CMB.2.raw
  modified_base (288)..(288): a, c, t, g, unknown or other
  modified_base (316)..(316): a, c, t, g, unknown or other
  modified_base (380)..(380): a, c, t, g, unknown or other
  modified_base (444)..(444): a, c, t, g, unknown or other
  modified_base (479)..(479): a, c, t, g, unknown or other
  modified_base (505)..(505): a, c, t, g, unknown or other
  modified_base (633)..(633): a, c, t, g, unknown or other
tcagagacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctgggtggagacgtggaggaggcttgacgtccgacggcccggggggtccctggacgtactctcctgtagagttctcgtggtcactgtcagtanctaactacataccgaacgtccgggtccnccgacggccgtaccggaacgggggaacgggccggaggtcggtactactaaacgtttagtttagngggacgtagtggtaacgtacgtacccgtacgcgacgtactccggtgcgacgggtccatccacgntctacagtaacacttaacttacaagtatacgttcnctaacctacaatacgaacctaaacgngaaacgaccgagaccgtacggtactattagttagtcgagaggtaagtcggtacggtagtagtaggtcgggtaggttacgtaccgggcgggtaccgtacggaaccgtcggtaccctaccgtctacccgngaccgtccc

SEQ ID NO: 403912 - DNA, 598 bp, Homo sapiens
  misc_feature: GZ8MTXP02JXQ5Z.3.70.G04.1.454.CMB.2.raw
  modified_base (301)..(301): a, c, t, g, unknown or other
  modified_base (380)..(380): a, c, t, g, unknown or other
tcagagacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtcctcctcatctatggancaacacaacgagggccacgtggcactcccagccaggttcagtggctaggtcggggtcgtggggacagtacttcaccctnactcatcacgcccgctagacgcctagaacgtattttgctagtttatacgtgtactagtcgtagggtttacttcgtcggtcccctacggtttccggcccgtagggaacctaaaggtggtaactactacgaaaacgtaacgttggtacgggacctacgacctaaccgtagtccttgttaccttcgtacttcccgttccccgactactcctacggtaacgg

SEQ ID NO: 403913 - DNA, 465 bp, Homo sapiens
  misc_feature: GZ8MTXP02JBGR1.3.70.G04.1.454.CMB.2.raw
  modified_base (275)..(275): a, c, t, g, unknown or other
  modified_base (312)..(312): a, c, t, g, unknown or other
  modified_base (316)..(316): a, c, t, g, unknown or other
  modified_base (320)..(320): a, c, t, g, unknown or other
  modified_base (324)..(324): a, c, t, g, unknown or other
  modified_base (332)..(332): a, c, t, g, unknown or other
  modified_base (337)..(337): a, c, t, g, unknown or other
  modified_base (343)..(343): a, c, t, g, unknown or other
  modified_base (348)..(348): a, c, t, g, unknown or other
  modified_base (401)..(401): a, c, t, g, unknown or other
  modified_base (443)..(465): a, c, t, g, unknown or other
tcagagacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgagacacggcgtatattatgtgcgagtagtacggtggtgaatgtgggtgttaacgtgggggcctgggaaccctgggtccaccgtctcctnacgccctccaccgaacggcccagtccgtcctccccgngccncccngccncgaggacncaccncgagcncacgngccggcctgggctgccgtggtaccaacggaccttacgtccgagtcgcttacgngtagcggccggggctcggggaacgtaagggccgacaataggnnnnnnnnnnnnnnnnnnnnnnn

SEQ ID NO: 403914 - DNA, 605 bp, Homo sapiens
  misc_feature: GZ8MTXP01D428P.4.59.F04.1.454.CMB.2.raw
  modified_base (224)..(224): a, c, t, g, unknown or other
  modified_base (266)..(266): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgganataaattgggacctaataaattgcttctggtatcagcagaanccaggccagtcccctatactgtcatctatacaagactaccaagccggcctacgaggactccctgacgcgtattctcgtacggcctccgtaaattcgtagggaaacctacgacgaccctaactcctacgaaccctacgtcccgaacccgggaccctaaggggccttaggtaacgagttcggaacggtacttaggtaacctttaagtttaaccgtcgtaccgaagggtccggtagggaccagacgtagcctacgtgggtaacgggttcggttacggggcgggaaggaccctaaggcgttcggacccgtccgtacgcgacgcccgaggtcccttcgcccccg

SEQ ID NO: 403915 - DNA, 511 bp, Homo sapiens
  misc_feature: GZ8MTXP01CIH6R.4.59.F04.1.454.CMB.2.raw
  modified_base (310)..(310): a, c, t, g, unknown or other
  modified_base (344)..(344): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaatgggccataaattgcttctggtatcagcagaagcaggccagtcccctatactggtcatctatcaagataccaagcggcctnagggactcctgagcgattctctggctccaattcngggaacacagccactctgaccatccaccgggacccaggctgtagatgaggctgactattactgtcgaggcgtgggacaggcaggcacgtggaaggtggttcgggcgggagggacccaaggcgttgacccggtcctacggtcaagccccgaaggtccttcgtcccccg

SEQ ID NO: 403916 - DNA, 513 bp, Homo sapiens
  misc_feature: GZ8MTXP01EUAXV.4.59.F04.1.454.CMB.2.raw
  modified_base (457)..(457): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgagataaattgggccataaattgcttctggtatcagcagaagccaggccagtcccctatactggtcatctatcaagatacccaagcggcctcagggactccctgacgcgattctctggcctcaaattcgagggaacacagccactctcgaccatcgacccgggacccaggctagtagatgaggctgactattacgtgtcgaggcgtgggacaggcagcacgtggaaggtgttcgggngggagggaccaaggcgttcggacccgtctacgtcacgcccagggccttcgcccccg

SEQ ID NO: 403917 - DNA, 494 bp, Homo sapiens
  misc_feature: GZ8MTXP01DQNCG.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgganataaattgggaccataaattgcttcctggtatcagcagaagccaggccagtcccctatactggtcatctatcaagataccaagccggccctcagggactccctgagcgattctctggctccaattctagggaacacagccactctgaccatccaccgggacccaggctgtagatgaggctgactattactgtcgagcgtggacagcagcactgaagtgttcggcggaggaccagcgttgaccgtcacgtcacgccgagcgttcgtccccg

SEQ ID NO: 403918 - DNA, 544 bp, Homo sapiens
  misc_feature: GZ8MTXP01ENEK9.4.59.F04.1.454.CMB.2.raw
  modified_base (236)..(236): a, c, t, g, unknown or other
  modified_base (508)..(508): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagacccctgtcccctcacctgcactgtctctggtnactcataagtgtttctctggagctggatccggcagcccccagggaaggactggagtggattggccatatctcttacagtgggagcaccaactacaaacccctccctacaagacgtcgtgtcacccgtgtacaatgacacgtccaagaaccagttctaccctgagctgagctctgtcgaccgccgcggacacggccgtgtatttctgtgcgagattctttcgatttttggagttcggtaaccccttggctacgttgggccagggaccctggcnccgttctcttcaacgcctccacaacgggccctaacg

SEQ ID NO: 403919 - DNA, 555 bp, Homo sapiens
  misc_feature: GZ8MTXP01C49PG.4.59.F04.1.454.CMB.2.raw
  modified_base (447)..(447): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccgcatcaccttctctgagataaatggccataattgcttctgtatcagcagagccaggccagtcccctatacgtggtcatctaatacaaagactaccaaagccggaccctacgagggactcccgtgacgcgtattctctggcctaccctaattcgtagggaaaccacacgccctactctcgaccactaccgaccgggaccctaggctagtagagtgaggctagactattactgtcgaggtcggngggacagacgacgcgaacgtgggagggttggttacgggacgggaagggaccgaaaggccgttcgaccgttcccgtaacgcaacgcccgaaggcctccgccccgtccgg

SEQ ID NO: 403920 - DNA, 514 bp, Homo sapiens
  misc_feature: GZ8MTXP01CDXLW.4.59.F04.1.454.CMB.2.raw
  modified_base (486)..(486): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaattgcttctggtatcagcagaagccaggccagtcccctatactggtcatctatcaagataccaagccggccctcgaggggactcccgtgagcgattctctggcctccaattcgtagggaacacacgccactctgaccatccgaccgggacccaggctgtagatgaggctgactattactgtcgaggcgtgggacagcagcacgtggaaggtggttcgggcgggagggaccaagcgttcgaccgtcncgtcgacgcccgaggtccttcgtccccg

SEQ ID NO: 403921 - DNA, 517 bp, Homo sapiens
  misc_feature: GZ8MTXP01BQ0WQ.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctgganataaattgggccataaatttgcttcctggtatcagcagaagccaggccagtcccctatactggtcatctatcaagataccaagcgccctcagggactccctgacgcgattctctggcctccaattctagggaacacagccactctcgaccatccgaccgggacccaggctgtagatgaggctgactagttactgtcagggcgtgggacagcagcactggaggtgttcggcgggagggaccgaagcgttacgccggttcctaacgtcaacgcccgaggcctcgcccccgtccgg

SEQ ID NO: 403922 - DNA, 530 bp, Homo sapiens
  misc_feature: GZ8MTXP01B6JR3.4.59.F04.1.454.CMB.2.raw
  modified_base (453)..(453): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaattgcttcctggtatcagcagaagccaggccagtcccctatactggtcatctatcaagataccaagccggccctcgagggactccccgtgacgcgtattcctctcggctccaaatttcgtagggaacacacgcccaactctgaaccatccgaccgggacccagggcctaggtagagtcgaggtctagactattactgtacgaggcgtgggacngcagcacgtggaaggtgttcgggcggagggaccagcgttcgacccgtctacgtcacggcccagggccttcgcccccg

SEQ ID NO: 403923 - DNA, 496 bp, Homo sapiens
  misc_feature: GZ8MTXP01ANXWZ.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaattgcttcctggtatcagcagaagccaggccagtcccctatactggtcatctatcaagataccaagccggccctcagggatccctgagcgattctctgggctccaaattctgggaacacagccactctgaccatcaccgggacccaggctgtagatgaggctgactattactgtcaggcgtgggacagcagcactgaacggtgttcgggcggagggaccaagcgttgaccgtcacgtcagcccaggcttcgccccg

SEQ ID NO: 403924 - DNA, 856 bp, Homo sapiens
  misc_feature: GZ8MTXP01ALBF4.4.59.F04.1.454.CMB.2.raw
  modified_base (225)..(225): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggccctcctatgaggtgactcagccaccctcagtcgtccgtcgtccccaggacagacagccggcatcactgctctganataatggcataattgcttctgtatcagcagacgccaggccacgtcccctatactcggtcatctatacaagactaaccgaagccggccctacgaggggactcccgtagacggtcgtactttcctcgtcgggtccctaacccgtaaatttccggtacggggaaacccacgaacggcccctaaaccttccgtacgaacccctacgttacccggaaacccccggggaccccgaacgggtacccgttacgggttaaaggaccgttagggaccggggtaccttaacgggtaaaccgtttaacgttttaaaccggttcgggttacccgggtaaacgggggtccccgggggttaaggggggaaaccccgaaaggggtacccgtaaacggggacccccgtaaaagggtttcccggggggtaaacgggggttttacggggtttccccggggggggtaacccgggggggttaaaccgggggtaaaacccccgggaaaaccggggttccccgggtttaacccggggaaacccccccggttttaacccccgggttaaaaccgggttcccccggtaaaaccgggtacccccccgggaaaaccgggggtccccgtttaacccccggggttccccccccccccgggg

SEQ ID NO: 403925 - DNA, 529 bp, Homo sapiens
  misc_feature: GZ8MTXP01ENQ25.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtcccccaggacagacagccggcatcaccttctctggagataaattgggccataaatttgcttcctggtatcagcagaagccaggccagtcccctatactggtcatctatcaagataccaagcggccctcagggactccctgacgcgattctctggacctccaattctagggaaccacagcccactctcgaccatccgaccgggacccaggcctgtacgatgaggctagacttagttactgtcagggcgtgggacaggcaggcacgtggaggtggttcgggcgggacgggacaaggcgttcgacccgttcctaacgtcaacgcccaggcctcgccccgttcgg

SEQ ID NO: 403926 - DNA, 657 bp, Homo sapiens
  misc_feature: GZ8MTXP01CSWIR.4.59.F04.1.454.CMB.2.raw
  modified_base (225)..(225): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccacctcagtcgtccgtcgtccccaggacagacagccgcatcaccttctctgganataagtggacctaattaatttgcttcctggtatcagcaagaacgccacggcctacgtcccctatacgtggtacatactatacaaagtactaaccgaagcccggaccctagacgggtacctccgtagaccgtcgtacttcgtcgtcggtacccttacctaagtttccgtaagggaaacctaccgacgaccctactccgtacgaacccacgtacccggaacccgggacccagggtaccgtaggtaagacgtaggacggtctacgtaacttagttacgtgtacgagggtcgagggacaggacgacgcgtacgtgggaacgggttcgggtacggggacggggaacggttaaccgaacggtccgttaccggacccgttaccgtaaccgaccgaaccgacccggtacggttccctaacccggttcccccgttaaccgg

SEQ ID NO: 403927 - DNA, 605 bp, Homo sapiens
  misc_feature: GZ8MTXP01EKHLG.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgganataaattgggcataaattgcttcctggtatcagcagaacgccaggccacgtcccctatactggtcatctatacaagactacccaagccggccctcgagggactccccgtgacgacgtattcctcgtacggcctccgtaatttcgtacgggaacacgacgccactctacgaccacgtaccgacccgggacccacggtcgtaggtaagacgtagacgggtactaggtaaccttagtttaacgtgtaccgacgggcggtacgggacgacggcgaggccacggtggtaagggttcgggttcggggacgggacgggaacccgaaggttccgttcggacccgtcccgttacgccgacgacccgacgggtcccgttcccggtcccccg

SEQ ID NO: 403928 - DNA, 573 bp, Homo sapiens
  misc_feature: GZ8MTXP01CV1EZ.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagagccaggccagtcccctatactggtcatctatacaagataccaagccggccctcgagggactcccgtgacgccgattctcgtggacctccaattcgagggaaccacacgcctactctcgaccacgtaccgacccgggacccagggctaggtagagtgagctagtactagtttacgtgtcgaggcgtgggacaggcagccacgtggagggtggttcgggacgggaacgggaccgaaacgggtcgttacggcccgttccgtaaccggtccgaaccggtccccgaacgggttcctcccggccccccgttccggg

SEQ ID NO: 403929 - DNA, 642 bp, Homo sapiens
  misc_feature: GZ8MTXP01AKKXM.4.59.F04.1.454.CMB.2.raw
  modified_base (236)..(236): a, c, t, g, unknown or other
  modified_base (398)..(398): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtcccctcacctgcactgtctctggtnactcataagtagtttctctggagctggactccggcacgccccgagggaacggacgtggagtggattggccatatctcttacaggtgggacgcaaccaactaccaacccctcctacaagacgtcgtcgtcaccgtgtaacaatcgacacgtaccaacgaaccngttctccctagaggctgacgtctcgtcggtcgacccggccggcggaccgacgggtccgttagttacgtttcgtgtcgcgagtattcgtttacgttagtttttcggacggtttaccggttaacccccgttgggtccttacggttcgggggtacccgaacggggtaaccccgttgggttcccgttaccggttccttccgttccgaaccgtcccttacccgaaccgtaaccgggttcccctaaccgg

SEQ ID NO: 403930 - DNA, 559 bp, Homo sapiens
  misc_feature: GZ8MTXP01CYG3X.4.59.F04.1.454.CMB.2.raw
tcagagcactgtagcacgaccggtgctcgatttagtacacacacttaaggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaatgggaccataaattgcttcctggtatcagcagaagccaggccacgtcccctatactggtcatctatacaagataccaagccggccctcgagggactccccgtgagcgtattcctcgtcgggacctccctaaagtttccgtacggggtaaccaccgacgccctaacgtctcgacccagtccgaacccgggacccaggcctaggtagatgaggctacgactattacgttgcgtagggcgtgggacagcagtcacgtgggaacggtggttcgggcggacgggaccagcgttcgacccgtctaacgtcacgcccgaaggtccttccggtccccg

SEQ ID NO: 403931 - DNA, 509 bp, Homo sapiens
  misc_feature: GZ8MTXP01EH4AV.4.59.F04.1.454.CMB.2.raw
tcagagcactgtagcacgaccggtgctcgatttagtacacacacttaaggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgagataaattgggccataaattgcttctggtatcagcagaagccaggccagtcccctatactggtcatctatcaagataccaagccggccctcagggactccctgagcgattctctgggcctccgaaatttcgtagggaaacacacgcccactctgaccatccgaccgggacccagggcctagtagatgaggctgactattactgtcgaggcgtgggacagcagcacgtggaaggtgttcgggcggaggccaagcttgaccgtctacgtcagcccaggtcttcgccccg

SEQ ID NO: 403932 - DNA, 684 bp, Homo sapiens
  misc_feature: GZ8MTXP01DNSLQ.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccaataaattgcttcctggtatcagcagaagccaggccagtcccctatactggtcatctatacaaagactaccaagccggcccctcgacggggactccccgtaggacgtcgtattcctcgtcgggccttcccaaagtttccgtacggggaaaccaccgacggaccctaaccttctacggaacccaacgtaccccggaaccccggggaaccccaggggtccttagggttaacgagttggaacggtctacggtaaccttaatttaaccgtgtaccggaggggtccggtaggggaaccaggccgaaggccgtaacgttggggaaggggtttcgggttccgggggacggggaaacggggaacccgtaaaggttcccgttcggaacccccggttccgttaacccggtcgaacccgggtaccccgaaacgggtcccgttccccggtccccccccgg

SEQ ID NO: 403933 - DNA, 593 bp, Homo sapiens
  misc_feature: GZ8MTXP01AYK6C.4.59.F04.1.454.CMB.2.raw
  modified_base (226)..(226): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtcccgtgtcccccaggacagacagccggcatcacctgctctgganataaattgggccataaattgcttcctggtatcagcagaacgccaggccagtccccctatactggtcatctatcaagactaacccgaagccggcccttacgacggggactccccgtgacgcgtactttcctcgtcgggcctccgtaaatttccgtaggggaaaccacacgccaactcctagacccatcccgaacccggggacccagggctagtagatgacggctagacttagttagtcgtacgaggtccggtaggggacaaggccaggctacgtggtaagggttcggttacgggcgggacgggaaccgtaaggccgttcggacccgtccgtacgtccacggccccgaacgggcccttcccggcccccg

SEQ ID NO: 403934 - DNA, 631 bp, Homo sapiens
  misc_feature: GZ8MTXP01EDMTW.4.59.F04.1.454.CMB.2.raw
tcagagcactgtagcacgaccggtgctcgatttagtacacacacttagggattgggggctgggcctcaggaagcagcatcggaggtgcctcagccatggcatggatccctctcttcctcggcgtccttgcttactgcacaggctccgtggcctcctatgaggtgactcagccaccctcagtcgtccgtgtccccaggacagacagccggcatcacctgctctggagataattggacattaaattgcttctggtatcagcagacgcaggccacgtcccctatactgtcatctatacaagactaccgaagccggaccctacgagggactccgtagacgcgtattctacgtcgcctcaattcgtagggaacctacacgccactctacgaaccagtccgaacccggggaccacggctaggtagagttagacgggtacttacggtaacttaacgtttacgtcggttacgaggggtccggtaggggacgacggcgaacggtcccgtacgttggggtaagggggttcggttccgggggaacggggttaacgggaaacccgtaaaggttccggttacggaccccggttccgtacgtccgaaccggacccggacgggtccccttaacccggtccccccgg

SEQ ID NO: 403935 - DNA, 509 bp, Homo sapiens
  misc_feature: GZ8MTXP01CCV5D.4.59.F04.1.454.CMB.2.raw
  modified_base (314)..(314): a, c, t, g, unknown or other
  modified_base (438)..(438): a, c, t, g, unknown or other
  modified_base (500)..(500): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaattgcttcctggtatcagcagaagccaggccagtcccctatactggtcatctatcaagataccaagcggccctnagggactcccgtgagcgattctctggcctccaattctagggaacacacgccactctgacccatccgaccgggacccagggctagtacgatgaggctagacttattacgtgtcaggcgtgggacngcagtcacgtgaagggtgttcgggcggaggaccagcgttcgaccgtcagtcagcccaggccncgtcccccg

SEQ ID NO: 403936 - DNA, 589 bp, Homo sapiens
  misc_feature: GZ8MTXP01AC7J7.4.59.F04.1.454.CMB.2.raw
  modified_base (357)..(357): a, c, t, g, unknown or other
  modified_base (504)..(504): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtcgtccccgaggacagacacgccggcatcacctgctcgtggataataaagttcgggacctaattaaatttgcttccgtggtatcagacagaacgccaggccacgtcccctatactggtcatctatacaagactaccaagccgcctgagggctcccgtgacgcgtattccncgtcggcctaactaactttccgagggaaaccacgtacgaccctaacttcacgaacccacgtacccggacccgggacccagggtccttaggagagttgaacggtcttaggaactttagttacgtgtaccgagggcgtagggacaggcngcacgtgggaaggtcggttcgggacggaggtaccagcgttcggaccgtccgacgtcgaccgtaccgacggtccgttccgtccccg

SEQ ID NO: 403937 - DNA, 544 bp, Homo sapiens
  misc_feature: GZ8MTXP01DNZN0.4.59.F04.1.454.CMB.2.raw
  modified_base (476)..(476): a, c, t, g, unknown or other
  modified_base (502)..(502): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaagttgggaccaattaaatttgcttcctggtatcagcagaagccaggccacgtcccctatactggtcatctatacaagactaccaagccggccctagagggactcccgtgacgcgtattctctcggacctacctaattcgtagggaaaccacacgcccactctacgaccagtaccgacccgggaccaggctagtaagatggagctagacttagttacgtgtacgagggcgtaggacagcagcacgtggnggtgtcgggcggacggaccgaagtcncgccgttccgtaacgcgaacgcccgaggcctccgccccgtcg

SEQ ID NO: 403938 - DNA, 511 bp, Homo sapiens
  misc_feature: GZ8MTXP01DWZUD.4.59.F04.1.454.CMB.2.raw
  modified_base (463)..(463): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggaccataaattgcttctggtatcagcagaagccaggccagtcccctatactggtcatctatacaagataccaagcggccctcgagggatccctgacgcgattcctcgtcggccttcctaaattccgtagggaaacacacgccactctgaccatccgaccgggacccagggctgtagatgaggctgactattactgtcaggcgtgggacagcagcacgtgaagtgttcggnggaggaccaagcgttgaccgtcaagtcacgccaggtccttcgtccccg

SEQ ID NO: 403939 - DNA, 583 bp, Homo sapiens
  misc_feature: GZ8MTXP01BJ4CD.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtgtccccaggacagacagccgcatcaccttctctgganataaatggacataattgcttctggtatcagcagacgccaggccacgtcccctatactggtcatctatacaaagactaaccgaacgccggaccctacgaacgggactcccgtagaccgcgtacttcctcgtcggtaccctactaagttccgtaacgggaaccacgacgcccactcctacgaccacgtccgaacccgggacccaggtactagtagagtaggagtctagtaccttattacgtgtacgagggcgtagggacagacgagtcacggtggaaggttcggtcgggacgggaggacccgaagcgttacggcccgttacgtaacgcgaacgcccgaggttccctaaccgcccccgtcgg

SEQ ID NO: 403940 - DNA, 712 bp, Homo sapiens
  misc_feature: GZ8MTXP01DPB3P.4.59.F04.1.454.CMB.2.raw
  modified_base (233)..(233): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcactgcactgtctctgtnactcataagtgtttctcgtggagtctggactccggcacgacccccgaaggggaagggacgtgggagtggattcggccatactctacttacgaggtggacgaccaaccaaacctaccaaccccctcctacaaacggtacgtccgtgtccaccgtgtaacaatcgacaaccgtaccaaacgaaccctacgtttcctaccccgtggaacggtcctaggacgtcgttacgtacggttccggaaccccggcccggaccgggaaccgtacccggggtcccgttaggtttaacgttttccggtgggttacgaccggtaagttaacgtttcgttttaccggttaaagtttttcgggaacggtttacccggttaaaccccgttggtaaccgttaacgggttcggggtacccgttaacgggtaacccgttggttacccgttccggttcctctaccgcgtcccacccgaccgtaaccgggccctaaccgg

SEQ ID NO: 403941 - DNA, 628 bp, Homo sapiens
  misc_feature: GZ8MTXP01D48YJ.4.59.F04.1.454.CMB.2.raw
  modified_base (236)..(236): a, c, t, g, unknown or other
  modified_base (247)..(247): a, c, t, g, unknown or other
  modified_base (415)..(415): a, c, t, g, unknown or other
  modified_base (439)..(439): a, c, t, g, unknown or other
tcagagcactgtagcacgaccggtgctcgatttagtacacacacttagggattggggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcataagtntttctctggagctggactccggcacgccccgagggaggactggagtggattggccatatctcttacaggtggagaccaaccaactaccaaccccctcctacacgtacgtcgtcgtcaccgtcgtaaccaatcgacacgtaccaacgacctagttctcctgacgctagngtctcgtgtcgaccgccgcggacncggtcgttgttacgttcgtgttcgacgtagtattccgttttggttaagtttttcggacggtttaccggttaaccccgttgggaaccgttacggttcggggaccgttacgggtaacccgttggttcccgttccggttacttccgttaccgcgtccctcccgaacccgtaaccgggttcccttaacccggg

SEQ ID NO: 403942 - DNA, 566 bp, Homo sapiens
  misc_feature: GZ8MTXP01DCT3I.4.59.F04.1.454.CMB.2.raw
  modified_base (235)..(235): a, c, t, g, unknown or other
  modified_base (455)..(455): a, c, t, g, unknown or other
  modified_base (528)..(528): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcataagtgtttcttctggagctggatcccggcacgcccccgagggaggactggagtggattggccatatctcttacagtgggagcaccaactaccaacccctcctacaagacgtcgtgtcaccgtgtacaaatcacacgtacaaacgaaccagttctccctgacgctgacgctcgtagtcgaccgccgcggacacggcgtgtacttctgtgcgagtnttccgttgttattttggacgttcggtaaccccttggaacttacggttcggggccagggtaaccctgggttccnccgttctcttcaagtccctcaccgaacggccctaaccg

SEQ ID NO: 403943 - DNA, 644 bp, Homo sapiens
  misc_feature: GZ8MTXP01AZUS4.4.59.F04.1.454.CMB.2.raw
  modified_base (287)..(287): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccgcatcactgctctggagataatggactataaattgcttctgtatcagcagagccaggccacgtcccctatactgtcatctanacaagactaccaagccgacctcgacgggactcccgtagacgtcgtattctcgtacggtccttaaccgaagtttccgtacggggtaaaccacctacggacccctactaccgttacggaaccctaacgtccccggaaaccccggggacccgaaacgggtccgtaaggtacggatacgggtaacggtctacggtaactttacggttaccgtggtacccggtaaggggtcggttacgggacaacggcgacgtacgtaccggtgggtaacggggttcgggttacggggaccggggacggaaccgaacggcgttaccgacccgttccgtacgcgtacggcccttagggcccttcggtcccccg

SEQ ID NO: 403944 - DNA, 681 bp, Homo sapiens
  misc_feature: GZ8MTXP01D7DHO.4.59.F04.1.454.CMB.2.raw
  modified_base (235)..(235): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcataagttgtttctctggagctggactccggcacgcccccgagggaaggactggagtggattggccatatctctacgagtgggagaccaacctaactacctaaccccctcctacgaacgtacgtcgtgtcaccgtgtaacaatcgacacgtaccaaacgaacctacgtctccctagacgctagacgtcctcgtcgtacggacccgccggaccggaccgaaccgggtccgttgttaacgtttcgtcggtacgaccggtagtactttccgttttcggttaacgttttttgggacggtttaccgggttaaacccccgttgggtaaccgttaacgggttcgggggtacccgttaacgggggtaaaccccgttggttacccgttaccggttccttccgttccgaaccgtccctacccgaacccgtaaccggggttccccttaacccgg

SEQ ID NO: 403945 - DNA, 624 bp, Homo sapiens
  misc_feature: GZ8MTXP01D0VK6.4.59.F04.1.454.CMB.2.raw
  modified_base (227)..(227): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtcgtccccaggacagacacgccggcatcaccttctctgganaataaattgggacctaataattgcttctggtatcagcaagaacgcaacggccacgtcccctatactggtacatctaatacaaagactaaccgaacgccggacctacgacggtactcccgtgacgtcgtattccgtcgtcggaccttacctaacgttcgtaacgggaaccaacacgtaccctactctacgaacccagacccgaaccgggacccagggacctagtaagactaggacgctaacgtaaccttaggtacttggtaccgagggacgtaggacagacagtccgtagtgggaagggttcggcgggacgggaaacggaccgaaacggtcgttaccggcccgttccgtaacgtccgaacggtccccgaagggttccctaacccggttccccgtccgg

SEQ ID NO: 403946 - DNA, 647 bp, Homo sapiens
  misc_feature: GZ8MTXP01APUDM.4.59.F04.1.454.CMB.2.raw
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggacgtggtgaagccttcggagacccctgtccctcacctgcactgtctctggtgactccataagttgtttctcgtggagctggactccggcacgccccgaggggaaggacgtggagtggagttggctatatctctacgaggtggagcaaccaactaccaacccctcctacaacgtcgtcgtgtccacgtgtaacaatcgaacacgtaccaagaacctagtcctccagagctagagtctcgtcgcgacccggccgaccggacgacggtcgttgttacgtttcgtggtcgcggtagtcgtttccgtttaggttacgtttttgggtacgttaccggttaacccccgttggtccgttaacggttcggggtaccgaaccgggtaaacccgttcgggttaccccgttacccgttccgtccttccgaacccgtcccctacccgacccggtaaccgggttcccctaaccggg

SEQ ID NO: 403947 - DNA, 654 bp, Homo sapiens
  misc_feature: GZ8MTXP01BB52D.4.59.F04.1.454.CMB.2.raw
  modified_base (324)..(324): a, c, t, g, unknown or other
  modified_base (367)..(367): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggacgaccctgtccctcacctgcactgtctctggtcactcataagttgtttctctggagctggactccggcacgccccgagggaggacgtggagtggattggccatatctctacgagtgggacnccaaccaactaccacccctcctacaagtcgtcgtctcaccgtntaacaatcgacacgtaccaaagaacctacgttcctccctaggacgtctacgacgcttcgtcgtcgaccgccgacggacgtaccggcgttgttactttcgtggtcgcgtagtacttcgtttacgttagttttcgggtacggttccggttaaccccgttggtaaccgttacgggttcgggggtacccttaacgggggtaaccccgttgggttaccccgaccggtttccttccgttccgtaaccgtccccgttacccgaacccggtaaccgggttcccgttaaccccggg

SEQ ID NO: 403948 - DNA, 717 bp, Homo sapiens
  misc_feature: GZ8MTXP01D06E7.4.59.F04.1.454.CMB.2.raw
  modified_base (305)..(305): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtcgtccccaggacagacagccggcatcacctgctgtggagtaataaagtggactaattaaattgcttcgtggtatcagacagaacgccgaggccacgtccctatactgtacatctaanacaagactaccgaagccgacctagacggactcccgtggactcgtacttctcgtacgcctaacgaagtttcgaagggaccacacgcctactcgtacacctacgacccgaaccgggaaccctagggtactaggtaacgagttacgggacggtacgttaggaaaccgtttacgtttaacgtcgggttacggaacggggttaccgggtacgggaaccgaaggacgtaaccggttcgaccgggttgggggtaaacggggttcggggttccgggggaaaccggggttaaaccgggaaacccggtaacgggttcccggtttacccggaaacccccgggttcccggttaaaacccgggcccggtaaacccgggtaccccggaaacggggttcccccgttaacccccggggttccccccgg

SEQ ID NO: 403949 - DNA, 616 bp, Homo sapiens
  misc_feature: GZ8MTXP01CHB1C.4.59.F04.1.454.CMB.2.raw
  modified_base (329)..(329): a, c, t, g, unknown or other
  modified_base (481)..(481): a, c, t, g, unknown or other
tcagagcactgtagcacgaccggtgctcgatttagtacacacacttagggattggggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagacccctgtccctcacctgcactgtctctggtgactccaattaagttgtttcttcgtggagctggatccggcacgcccccgagggagggactggagtggattggccatatctcttacagtgggancaaccaactaccaaccccctccctcaagaccgtcgtcgtcaccgtgtaacaatcgacacgtaccaaagaccagttcctccctgacggtctggacgtctcgtgtcgacccgccggcggaccgacggccgtgttacgtttctggttgccgagtnttcgtttgttagtttttggagttcccgggtaaccccttggccgttacgttcgggggaccttacggggtaaccccttggttccgcccggttctcttccgaacgtccctacccgaccgtaacggccccgttaaccgg

SEQ ID NO: 403950 - DNA, 548 bp, Homo sapiens
  misc_feature: GZ8MTXP01DD3TX.4.59.F04.1.454.CMB.2.raw
  modified_base (219)..(219): a, c, t, g, unknown or other
  modified_base (225)..(225): a, c, t, g, unknown or other
  modified_base (323)..(323): a, c, t, g, unknown or other
  modified_base (434)..(434): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagcccaccctcagtgtccgtgtccccaggacagacagccggcatcaccttcnctgganataaattggccataattgcttctggtatcagcagagccaggccacgtcccctatactgtcatctatacaagataccaagccgccctgacgggactccngacgcgattctctggcctacaattcgtgggaaacacacgccactctacgaccactccgaccgggacccaggctgagatgagctagactagttactggtcaggcgtgggacnggacagcgtacgtggtagggtcggtcgggacgggacggggaaccaacggtcgttaccggttcccgttccgtaaccgtacgaaccgcccgaacggcctcccgccccgttaaccgg

SEQ ID NO: 403951 - DNA, 604 bp, Homo sapiens
  misc_feature: GZ8MTXP01B5JL5.4.59.F04.1.454.CMB.2.raw
  modified_base (208)..(208): a, c, t, g, unknown or other
  modified_base (336)..(336): a, c, t, g, unknown or other
  modified_base (341)..(341): a, c, t, g, unknown or other
  modified_base (442)..(442): a, c, t, g, unknown or other
  modified_base (449)..(449): a, c, t, g, unknown or other
  modified_base (476)..(476): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccacctcagtcgtccgtcgtccccaggacagacagccgnatcactgctgtgatataagtggactaattaaattgtcttcctggtatcagacagacgcacggaccacgtacccctatactgtacatctatacaagtactaccaacggcggccctagacgggcttccgngacgngtattccgtacgtcggacctaaccgtaagtttcgacggggaaaccacgaacccgcctaacttcgacgaacctacgccgaaccgggacccaggtctagtagntgacgtntagtacgttactacggtgtacgagggngacggacgagtacaccgtgaagtgggtcggtcgggttacgggacgggaacggaaacccgaagttccgttccgttaccccggtcctaacggtccaccgggacccacgggtcccttaacccggtcccccg

SEQ ID NO: 403952 - DNA, 714 bp, Homo sapiens
  misc_feature: GZ8MTXP01A4MOZ.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctgagataattggaccataattgcttcctggtatcagcagaagccaggccacgtcccctatacctggtacatctatcaagtactaccaagccggcctacgacggactcccgtagaccgtcgtattccgtacgtcggtaaccttacccaacgtttcgtacggggaaaccaccgacgaccctaactcctacgaacccacgtacccggaaccccggggaacccaggggaccttagggtaacgtagtacgggaacgggtaccttaggtaacctttaacggttacgttcggttaccggaacggggtccggttacggggaaccaggaccgacggtaccgtaaccggtgggtaacgggggttcggttaacccgggggacggggaaaccggggacccgaaaggggtcccgttaaccgggttccccggtttacccgtaacccggtaccgaacccgggaaccccgtaaccgggccccgttaacccgggttcccccccgttcccggg

SEQ ID NO: 403953 - DNA, 570 bp, Homo sapiens
  misc_feature: GZ8MTXP01C3RHV.4.59.F04.1.454.CMB.2.raw
  modified_base (384)..(384): a, c, t, g, unknown or other
  modified_base (559)..(559): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtgtccccaggacagacagccggcatcacctgctctggagataaattgggacctaattaaattgcttctggtatcagcagaagccaggccacgtccctatactgtcatctatacaagactacccgaagccggccctcgacgggactcccgtgacgtcgtattctctcgggccttccgtaaatttccgtagggaaaccncacgccactctagaccatccgaccgggacccaggctggtagagtgaggtctacggtacttacttacgtagtcgacgggcgtcggggacagctagcacgtggaagggttcggttcggggcgggaaggaccgaaggttcgttcggacccgttcctacgtccgacgcccacgggtccnccggtcccccg

SEQ ID NO: 403954 - DNA, 603 bp, Homo sapiens
  misc_feature: GZ8MTXP01EM6OC.4.59.F04.1.454.CMB.2.raw
  modified_base (216)..(216): a, c, t, g, unknown or other
  modified_base (235)..(235): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtcccctnacctgcactgtctctggtnactcataagtgtttctctggagctggatccggcacgcccccgagggaaggactggagtggattggccatatctctacagtggagcaaccaactaccaacccctcctacaacgacgtcgtgtcaccgtgtaacaatcgacacgtaccaaacgaaccagttactccctgacgctgagctctgtcgaccgccgcggacacggccgtgtactttcgtgtgcgtagtattcgtttcgtattttggacgttaccggttaaccccttggtccgttaacgttcggggtcccgttaacggggtaacccgtggttaccgacccggttctcctttccgaacggtccccttaccgaacccgtaacgggttcccctaacgg

SEQ ID NO: 403955 - DNA, 769 bp, Homo sapiens
  misc_feature: GZ8MTXP01BB5DL.4.59.F04.1.454.CMB.2.raw
  modified_base (223)..(223): a, c, t, g, unknown or other
  modified_base (251)..(251): a, c, t, g, unknown or other
  modified_base (259)..(259): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtcgtccccaggacagacagccgcatcacttctctgganataatggactaataattgcttctgtatnagcagacnccgaggccacgtcccctatactggtcatactatacaaagactaaccgaacgccggtaccctacggaacgggtactccccgtaggtaccgtccgtactttccgtcgtcggtaacccttaccctaagtttccgaacggggaaacccaaccgtacggtacccctaacgttcccgtaaccggaaccctaaccgttaccccgggaaccccgggggaaccctacgggtaccgttaagggttaacgaggttacgggaacggttaccgttaaggtaaccgtttaacgtttaccggtacgggttaaccggagggggtacccggtaggggaaccgtacggaaccgtacggtaccgtacggttagggtcgggggttaacggggttacccgggggaacggggaaaccggggttaaccctaacgggggtaccttaccggggttaacccccggttaccgtaacccgggtcgaacccgggacccggtaacggttccccgtaaccccggttccccgttaacccggg

SEQ ID NO: 403956 - DNA, 618 bp, Homo sapiens
  misc_feature: GZ8MTXP01AW0IS.4.59.F04.1.454.CMB.2.raw
  modified_base (571)..(571): a, c, t, g, unknown or other
  modified_base (585)..(585): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactcctataagttgtttctctggagcgtggatccggcacgcccccgagggaacggctggagtggattggccatactcttactacgagtgggacgaccaacccgaacctaccaaacccccttccctacaacgtccgtcgtgtaccaccgtgtaacaataacgaccaccgtaccaaacgaacctagttctcccctaggacgctagacgtctcgtacgtcgaccgccgacggacaccgggtcgtgtacgtttcgtgtcgcgtatgttcgttgttagttttggacgttccggttaacccctggccttacggttcggggccacgggtaacccttggttccncccggttctcgtcncggtcccctaccgaccgtaacgggccctaaccg

SEQ ID NO: 403957 - DNA, 632 bp, Homo sapiens
  misc_feature: GZ8MTXP01BXXP4.4.59.F04.1.454.CMB.2.raw
  modified_base (228)..(228): a, c, t, g, unknown or other
tcagagcactgtagcacgaccggtgctcgatttagtacacacacttagggattgggggctgggcctcaggaagcagcatcggaggtgcctcagccatggcatggatccctctcttcctcggcgtccttgcttactgcacaggctccgtggcctcctatgaggtgactcagccaccctcagtcgtccgtcgtccccaggacagacagccggcatccaccttctctgganataatggacataattgcttctgtatcagcagacgcaggccacgtcccctatactggtacattctatacaaagactaacccgaacggcccggtaccctacgacgggtactcccgtagaccgtcgtattctcgtcggacctactaatcgtacgggaactacgacgaccactctacgacctacgtacccggacccgggacccagggtaccgtaggtagacgtaggacggtactagtaacttagttacgtggtacgacgggtcggtacggacgaggaccagtcgtacggtgggtaggggttcgggtaccggggacggggaacggaccgaacggccgttaccggacccgttaccgttaaccgccgaaccgccccggaacggttcccgtaacccggttcccccgttccgg

SEQ ID NO: 403958 - DNA, 700 bp, Homo sapiens
  misc_feature: GZ8MTXP01DU4GV.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtgtccccaggacagacagccgcatcacctgctcgtggagaataaagttgggacctaattaaattgtcttccgtggtatcagacagaacgccaggcccacgtcccctatactgtacatctatacaaagactaacccaaggccggcccctacgaacgggtctcccgtagacgtcgtacttcctcgtacgggaccttcccgtaaagttccgtaaggggaaaccacgacgaccctaacctccgtagaaaccctacgtacccgaacccggggtaacccaggggtcctagggtaacgagttgaacgggtcttaacggtaacgtttactttaacgtcggttacgaggggtccgtaggggaacacgggctaaggcctaacgggtgggtaacggggttcgggttccgggggaacggggttaacgggtaaacccgtaagggttcccgtttacgggaaccccgttaaccgttaaccgggtaacacccggtaccccggacggggtccccttcccgggtccccccgg

SEQ ID NO: 403959 - DNA, 605 bp, Homo sapiens
  misc_feature: GZ8MTXP01EY6EA.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatccacctgctcgtaggagtaataaagttgggacctaattaaatttgcttcctggtactcagcagaacgccaggccacgtcccctatacgtggtcatctatacaagtactaacccgaagccggccctacgagggactcccgtgacgctacttcctcgtcggcctcctaagttccgtacgggaaaccacacgaccctactctacgacccacgtcccgaacccgggaccacgggccttaggtacgagtcggacggtctacgtacgttacttacggtgtacgagggtcgtaggacgagcgagtcgacgtgggtaaggttcgggttacggggacggttacgggacctaaggccgttcggacccgtctacgtcgacgacccgacggtcccgttccgtccccg

SEQ ID NO: 403960 - DNA, 611 bp, Homo sapiens
  misc_feature: GZ8MTXP01CLSCL.4.59.F04.1.454.CMB.2.raw
  modified_base (180)..(180): a, c, t, g, unknown or other
  modified_base (270)..(270): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccacctcagtntccgtgtccccaggacagacagccggcatcaccttctcgtggagattaaagttgggacctaattaaatttgcttcgtgtatcagcagaancagccagtccctatactgtcatcatacaagataccaagccggcctgacggactcctgacgcgtattctcgtgtacttacctaactttcgacgggaaacacgacgaccctactctacgaccagtacccgaccgggaacccagggacttacggagtaacggaggacgtactacgtaacttacgttacgtacggtacgacgggtcggaggacgacggtacgacgcgtacgtcgggtagggtcgggtacgggacggggtaacggaccgaacggtccgttacggacccgttacgtaacccgaccgaaccggtacccgacgggttcccgtccccgttccccggttcg

SEQ ID NO: 403961 - DNA, 768 bp, Homo sapiens
  misc_feature: GZ8MTXP01BEE2Y.4.59.F04.1.454.CMB.2.raw
  modified_base (265)..(265): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtgtccccaggacagacagccggcatcacctgctctggagataagttggactattaaattgcttctgtatcagcagacnccaggccacgtccctatacgtgtacatctatacaagactaacccgaagtccggaccctacgacgggactcccgtgacggtcgtatttcccgtcgtacggcccttaaccgtaaacgtttccggtaacggggaaaccctaccgaaccggtacccctaaccgttacccttaccggaacccctaacggtaccccgggaaaccccggggaaccccgtaacgggtcccgttagggttaaacggacgttacggggaacgggtaccttacggtaaacgtttacgtttaacggtccggttacgggacggggtacggtacgggggaactacgggaccgtacgggaccgtaacgggtgggtaaacggggtttcggggttacgggggacccggggttaaacggggaacccgtaacggggttcccgttcgggaacccccggtttccggtacccgggtaaccgaccccgggtaccccgaaaccgggttccccggttaaccccgggttcccccccggg

SEQ ID NO: 403962 - DNA, 656 bp, Homo sapiens
  misc_feature: GZ8MTXP01EW5NK.4.59.F04.1.454.CMB.2.raw
  modified_base (327)..(327): a, c, t, g, unknown or other
tcagagcactgtagcacgaccggtgctcgatttagtacacacacttagggattggggctgggcctcaggaagcagcatcggaggtgcctcagccatgccatggatccctctcttcctcggcgtccttgcttactgcacaggctccgtggcctcctatgaggtgactcacgccaccctcagtcgtccgtcgtccccaggacagacagccggcatccaccttctctggatataagtggacctaattaatttgcttctggtatcagcaagagccaggccacgtcccctatacgtgtcatctatacaagactaccgaacggccgtacccgngacgggactccccgtgaccgacgtacttccgtacgtcggtaaccctacctaagttcgtaacgggaacccacaccgtaccacttacaccgaaccacgtacccgaacccgggacccaggtaccgtaggttaacgagttacggaacggtctacggtaacttacggttacgttcggtcgacggggtcggtacgggacgtacgaccgaacgccgtaacgtgggtacgggttcggggtaccggggacgggaaacgggaccaaacgggtccgttacggttccccgttcgtaaccggtccaaccggacccgacggcccgttaacccgccccgttccg

SEQ ID NO: 403963 - DNA, 624 bp, Homo sapiens
  misc_feature: GZ8MTXP01CM8TP.4.59.F04.1.454.CMB.2.raw
  modified_base (225)..(225): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtcccccaggacagacagccggcatcaccttctctgganataaagttgggacctaattaaatttgcttccgtggtatcagcagaacgccaggccacgtcccctatactggtcatctatacaagactaccaagccggccctagacgggtactcccgtgacgcgtattctcgtcggaccttaccgtaattcgtaacgggaaccacgacgcctactctacgaccagtcccgaaccgggacccaggtacctaggtagagtggacgtctagtacttagttacgtggtcgagggtcggtaggaccagacgagtccgtagtagggtggggttcggttccggggacggggtacgggaaccgaaacgggtccgttaccgggttcccgttacccgtaaccgtccgaaccggccccgtacgggcccctcccggttcccccgttaaccgg

SEQ ID NO: 403964 - DNA, 590 bp, Homo sapiens
  misc_feature: GZ8MTXP01BMAQB.4.59.F04.1.454.CMB.2.raw
  modified_base (236)..(236): a, c, t, g, unknown or other
  modified_base (252)..(252): a, c, t, g, unknown or other
  modified_base (254)..(254): a, c, t, g, unknown or other
  modified_base (258)..(258): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagacccctgtccctcacctgcactgtctctggtnactcatagtgttctcngnctgntcgcagcccaggagctggagtgatggcatatctctacagtggagcacaactacaacccctcctacaagcgtcgtgtcaccgtgtacaatgacacgtacaacgaacctagttctcactgacggtctgagctcgtgtcgacccgcgcgacgacgggtccgttggtactttcgtgtcgtcgaggtacttcgtttacgtagtttttgggacgttccggttaaccccgttgggtaccttacggtcgggggacccgtaacggggtaaccccttgggttcccttacccggttccttccgttcgaccggtcccttacccgaacccgttaaccgggtcccc

SEQ ID NO: 403965 - DNA, 663 bp, Homo sapiens
  misc_feature: GZ8MTXP01BQ12V.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcactccaccttctctggagataagttggacctaattaaatttgcttccgtggtatcagaagagccaggccacgtcccctatactggtacatctatacaagaactaccaagcccgccctacgacgggactacccgtgacgtcccgattctcgtgtcctaaccaattcgagggtaaaccacacgacccactctacgaccaagtaccgacccgggacccaggacgttacgaagataggaacgtcgtaacgtattaacgttacgtaggttcgaacgggcgggtacgggacacgggaccaagccgtaaaccggttcgggagggttcggggttaaccgggcggggaaaccgggggtaccaaacggggtccctacggttaaacccccggttccgttaacccggtccgaacccggtaaccccgaacgggtccccgttaccgtcccccccggttaacggttcccc

SEQ ID NO: 403966 - DNA, 755 bp, Homo sapiens
  misc_feature: GZ8MTXP01AVWBI.4.59.F04.1.454.CMB.2.raw
tcagagcactgtagcacgaccggtgctcgatttagtacacacacttaaggattggggctgggcctcaggaagcagcatcggaggtgcctcagccatggcatggatccctctcttcctcggcgtccttgcttactgcacaggctccgtgcctcctatgaggtgactcagcccaccctcagtcgtccgtcgtccccaggaccagacaggccgcatcactgctcgtggatataaagttgggacctaattaaatttgtacttccgtaggtactcagcaagacgccgacggcctacggtcccctaataccgtaggtaccatactatacaagactacccgaaagccggccctagacgggactccccgtagacgtcgtagttcctcgtacggacccttaaccgtaaatttccgaacggggaaaccaccgaacggtccctaaacttccgtacggaacccctacgtaccccgaaaccccggggtacccaaacgggtccttacggtaagagtacgtaacgggtaccttacggaaactttaacgttaaccgtcgggttacccgtaaaggggcccggttagggggaaacctacggaccggaaacgttccgaaccgggtagggtaacggggtttacggttaccggggggacggttaaacgggtaaccccgaaagggttccgtttacccgggaccccggttttaacctacccgggcgaaaccccggggtaccccaacggggtcccctttccccgggtaacccccccggg

SEQ ID NO: 403967 - DNA, 605 bp, Homo sapiens
  misc_feature: GZ8MTXP01EWR9W.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtgtccccaggacagacagccggcactcactgctctggagataattggactataattgcttctgtatcagcagaacgcaggccacgtcccctatactggtcatctatacaagactaccaagccggccctacgacgggactccgtgacgtgtacttctcgtacggtctcctaaagttcgagggtaaccacacgccactacctacgaccctagtacccgaaccgggaccctacggcgttagtaagactaggacggtactacggtaaccgtttaattacgtacggtcgacggggtaccggtggggaacgaacggcgtagaccgtacgtgggaagggtttcggttccggggacgggacggggacctaagggccgttcggacccgtccgtacgtccgacgccgacgtccgttcccgtaacccccg

SEQ ID NO: 403968 - DNA, 762 bp, Homo sapiens
  misc_feature: GZ8MTXP01BYKD8.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgcccaccctcagtcgtccgtcgtccccgaggacagacagccggcatccacctgctcgtaggataattaagttggacctaattaaacttcgtcttccgtaggtatcgagacaagacgccgacggcctacgtacccctagtacgtcggtactacttctaactacaaacgtactaacccgaacggtcccggtaccccttacggaacggggtaccttccccgtaggtacggtccgttactttcccgtcgttaccgggtacccttaacgtaaacgtttccgggaaccgggaaacctaccgacggaccctaccgtaccgtacgaaccctaccggtacccggaccccgggaccgtacggtacgttacggtaagtacgttaggacgtacgtacgttaacttacgttacggtcgtacggacgggtacgacgggacacggtcgacgtacgtacgggtgggttaacggggttcgggacggggaaccgggttacgggtaccctaaggggttacccgttccggggttaaccccgttccccgggtaacggtccccggaccgggaccccgggttaacccgggtccccgttcccccgggttccccccgg

SEQ ID NO: 403969 - DNA, 725 bp, Homo sapiens
  misc_feature: GZ8MTXP01CUCSE.4.59.F04.1.454.CMB.2.raw
  modified_base (234)..(234): a, c, t, g, unknown or other
  modified_base (253)..(253): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcactgcactgtctctggtnactcattaagtgtttctcnggagcgtggactccggcacggcccccgaaggggaagggacgtgggagtggattggccatactctcgttacgaggtcgggacgaccaaacccaacctacccaacccccttccctacgaacggtacgttaccggtcgtacctacccggtacgtaaacctaaagtaacgacctaaaccggtaacccaaacgaaacccctacgtttccctacccgttaggacggccttggacgtcctcgtcgttccggacccgccggaccggaccgacgggtccgttagttacgtttcgtggtcgcgtagtattcgtttagtagttttgggacgttaccggttaaccccgttgggtaaccgtaccggttcgggggtacccgacgggggtaaaccccgttgggttaccccgttacccggttcctttccgttaccgtaacccgtcccgtacccggttacccgtaacccggggttccccttaacccggg

SEQ ID NO: 403970 - DNA, 700 bp, Homo sapiens
  misc_feature: GZ8MTXP01AQVT1.4.59.F04.1.454.CMB.2.raw
  modified_base (208)..(208): a, c, t, g, unknown or other
  modified_base (224)..(224): a, c, t, g, unknown or other
  modified_base (570)..(570): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggnatcactgctcgtgganattaaagttcgggacctaagttaaatttcgcttccgtaggtactcgagcagaacgccgacggccacgtacccctataccgtgtcatctaatacaagtactaaccgaacgccggacccttacgagggtactcccgacgaggacgtacttccgtcgtaacggccttaaccgaaacgtttacggaacggggaaacccacgaacggtaccctaaactccgttaacggaaccctaacgtacccggaaacccgggtacccagggtcctaggtaagacgtaggaacgtctacggtaacttacgttaaccgtgtaccggagggccggtagggacacggaccgtagaccgtacgnggggtaacggtcggttccgggggaaccggaacggggtacctaacggttcccggttacgttaccccggttcccgtaaccgtcggaaaccccgcccggttaaccgggtccccttccgggttaacccccccgg

SEQ ID NO: 403971 - DNA, 666 bp, Homo sapiens
  misc_feature: GZ8MTXP01AN913.4.59.F04.1.454.CMB.2.raw
  modified_base (267)..(267): a, c, t, g, unknown or other
  modified_base (276)..(276): a, c, t, g, unknown or other
  modified_base (309)..(309): a, c, t, g, unknown or other
  modified_base (314)..(314): a, c, t, g, unknown or other
  modified_base (330)..(330): a, c, t, g, unknown or other
  modified_base (391)..(391): a, c, t, g, unknown or other
  modified_base (444)..(444): a, c, t, g, unknown or other
tcagagcactgtagcacgaccggtgctcgatttagtacacacacttagggattggggctgggcctcaggaagcagcatcggaggtgcctcagccatggcatggactccctctcttcctcggcgtccttgcttactgcacaggctccgtggcctcctatgaggtgactcacgcccaccctcagtcgtcccgtcgtccccaggacagacacgccgcatcatctgctcgtggataattaagttcggactaattaattcgtcttcgtgtangagcagacncgacggcctacgtccctatcgtcgtacatctanacaanactacgacgccgaccncgacggtactccccgtgacgtctacttctcgtacgtcctacgtacgttccggacggaaccnctacgtaccctactcgtaccgaaccgacgtaacccgggacccggtaaacccgnggtacgttacggtaagacgtacgggagttacccgtaaggtaacccgtttaagttaccgtaacgggttccggaacggggtcggtaacgggaaccgtagggaccgtacggaccgttgggtaagggttcggggttacgggtccgggacggggtaacgacgttacggcccgttaccggaaccgttaccgtcggaccgacgacccgtaaccggcccgttaaccccgg

SEQ ID NO: 403972 - DNA, 504 bp, Homo sapiens
  misc_feature: GZ8MTXP02HBMAR.4.59.F04.1.454.CMB.2.raw
  modified_base (416)..(416): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaattgcttcctggtatcagcagaagccaggccagtcccctatactggtcatctatcaagataccaagcggccctcagggactccctgagcgattctctggctccaattctgggaacacagcccaactctgacccatccacccggggcccaggcctgtagatgaggctgactattacngtcaggcgtgggacagcagcacgtgaggtgttcggcgggagggaccaagcgtggacctcgacgtcacgccccaaggcctcggcccccg

SEQ ID NO: 403973 - DNA, 527 bp, Homo sapiens
  misc_feature: GZ8MTXP02HR1XA.4.59.F04.1.454.CMB.2.raw
  modified_base (282)..(282): a, c, t, g, unknown or other
  modified_base (335)..(335): a, c, t, g, unknown or other
  modified_base (406)..(406): a, c, t, g, unknown or other
  modified_base (424)..(424): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctanactggtcatctatcaagataccaagccgcctcagggatccctgagcgattctntcggctccaaattcagggaaccacacgccactctacgacccatccgacccggggacccagggcctgtacgntgagctgacttattacgngtcgaggcgaggacagcagcgagtggacggtcggtcgggacggaggaccaacgtcgtacgacccgtccgacgtccgacgacccgacggtcctacccgtccccg

SEQ ID NO: 403974 - DNA, 555 bp, Homo sapiens
  misc_feature: GZ8MTXP02F5QHF.4.59.F04.1.454.CMB.2.raw
  modified_base (387)..(387): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaggactggagtggattggccatatctcttacagtggagcaccaactacaacccctccctcaagacgtcgtgtcaccgtgtcaatgacacgtccaagaaccagttcncctgaggctgagctctgtcgaccgccgcggacacggccgtgtatttctgtgcgagattctttcgtatttttggagttcggtaacccccttggcttacgtggggcctacggggaaccctcggtaccaccggttctcgttcgacgtccctccgaccgaacgggccctacg

SEQ ID NO: 403975 - DNA, 491 bp, Homo sapiens
  misc_feature: GZ8MTXP02HPY0M.4.59.F04.1.454.CMB.2.raw
  modified_base (332)..(332): a, c, t, g, unknown or other
  modified_base (362)..(362): a, c, t, g, unknown or other
  modified_base (457)..(457): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccacctcagtgtccgtgtccccaggacagacagccggcatcaccttctctggagataaatggcataaattgcttctggtatcagcagaagccaggccagtcccctatactggtcatctatcaagataccaagcggaccctgagggactccctgacgcgattcnctggctacattcgaggaacacagccactcngaccatcgaccggaccagctgacgatgagctagactattactgtcgagggcgtagggacagcgagcacgtgaggtcgtcggcggacggacaagcncgaccgtctaacgcacgccaagccacgcccctcg

SEQ ID NO: 403976 - DNA, 733 bp, Homo sapiens
  misc_feature: GZ8MTXP02GRGZ3.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagcccaccctcagtcgtccgtcgtccccaggacagacagccggcatcaccttctctggagtataagttgggacctaattaatttgcttctggtatcagcagacgccacggccacgtcccctatacgtggtacatctatacaaagactaaccaacgccggaccctacgacgggactccccgtaggaccgtaccgtactttcctcgttcggtacccttaccgtaacgtttccgaacggggaaacctaccgaacgaccctaaccgttcctaccgaaccctaacgtacccggaaccccggggacccacgggtacctaggttaacgagtacgggacggtctaacggttaacttaacgtttacgtcggtaccgtaacggggtcggtacggggaacacggaccgaacggaccgtaacggtaggggtaacgggttcgggttacccgggggaacggggtaaaccggggaaacccgaaacgggtcccgttaaccgggtaacccccgttacccgttaaccggtaccgaacccggaccccgtaaacggtccccgtaccccggtcccccgtttacccgg

SEQ ID NO: 403977 - DNA, 578 bp, Homo sapiens
  misc_feature: GZ8MTXP02G7I50.4.59.F04.1.454.CMB.2.raw
  modified_base (207)..(207): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccgnatcaccttctctggagataaattgggacctataaattgcttcctggtatcagcagaagccaggccagtcccctaatactggtcatctatcaagataccaagccggccctacgaagggactccccgtgactcgtatttctctcggacctacctagttccgtagggaaacctacacgccaactctacgaacccactccgaacccgggacccagggctgtagataggagctagacttattacgtgtcgtagggcgtggacgagcgagcacgtgaggtcggtcgggacggacgggaaccaacggtcctacgggaccctaccgttaacggtccaaccggacccgaaacggccgttacccggacccccgttaccggg

SEQ ID NO: 403978 - DNA, 536 bp, Homo sapiens
  misc_feature: GZ8MTXP02GQNHD.4.59.F04.1.454.CMB.2.raw
  modified_base (234)..(234): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtagtttctctggagctggatccggcagcccccagggaaggactggagtggattggccatatctcttacagtgggagcaccaactacaaacccctcctcaagacgtcgtgtcaccgtgtcaatgacacgtccaagaaccagtctcactgaggctgagctctgtgaccgccgcggacacggccgtgtatttctgtgcgagatctttcgattttggagtcggtaacccccttggctacgtggggccacgggaaccctggtccaccgtctcttcacgcctccaccgtaacggcccc

SEQ ID NO: 403979 - DNA, 517 bp, Homo sapiens
  misc_feature: GZ8MTXP02IF2SO.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctgagataaatggcataattgcttctggtatcagcagaagcaggccagtcccctatactggtcatctatcaagatacaagcggcctcagggactccctgacgcgtattctctggctccattcgtaggaaaccacacgccactctagaccatccgacccgggacccagctagtagagtgagctagacttattactgtcagggcgtgggacagcgagcacgtgaggtcggtcggcggacggacgaacgcgtacgacccgtccgtaacgtcgacgcccgaaggtccgtccgcccccgtccgg

SEQ ID NO: 403980 - DNA, 590 bp, Homo sapiens
  misc_feature: GZ8MTXP02JPH3Y.4.59.F04.1.454.CMB.2.raw
  modified_base (235)..(235): a, c, t, g, unknown or other
  modified_base (254)..(254): a, c, t, g, unknown or other
  modified_base (394)..(394): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtccctgtcccaggtgcagctgcaggagtcgggcccaggactggtgaagccttcggagaccctgtccctcacctgcactgtctctggtnactccataagtgtttctcnggagctggatccggcacgcccccgagggaaggactggagtggattggccatatctcttacagtgggagcaccaactacaacccctccctcaagacgtcgtgtcaccgtgtacaatcgacacgtccaaagaaccagttccnccctgacgctgagctcgtgtcgaccgccgcggacgaccggccgtgtatttcgtgtgcgagtacttcgtttacgtagtttttggacgttcggttaaacccccgttgggtaccttacggtcgggggccctaacgggggtaaccctcgggtccaccggttctccgttcgacgtccctaccgaccgtaacgggccctacg

SEQ ID NO: 403981 - DNA, 506 bp, Homo sapiens
  misc_feature: GZ8MTXP02H5S9Q.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtccccctatactggtcatctatcaagataccaagcggccctcagggatccctgagcgattctctggctcaattctgggaacacagccactctgaccatcacccgggacccaggctgtagatgaggctagacttattactgtcgaggcgtgggacagcagcacgtgaggtgttcgggcggaagggaccaagcgtacgaccgtcgtacgtcacgcccgaacggcctcgcccccg

SEQ ID NO: 403982 - DNA, 490 bp, Homo sapiens
  misc_feature: GZ8MTXP02GMYXY.4.59.F04.1.454.CMB.2.raw
  modified_base (415)..(415): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagctggcatcacctgctctggagataaattgggccataaatttgcttcctggtatcagcagaagccaggccagtcccctatactggtcatctatcaagataccaagcggccctcaggggatccccctgagcgattctctggctccaattctgggaacacagccactctgaccatccaccgggacccaggctgtagactgaggctgactattacngtcagcgtgggacagcagcacgtgaggtgtcggcggacggacaagctgaaccgtcgtacgtcagcccaagctccg

SEQ ID NO: 403983 - DNA, 524 bp, Homo sapiens
  misc_feature: GZ8MTXP02I4ZFJ.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaattgcttcctggtatcagcagaagccaggccagtcccctatactggtcatcatcaagataccaagccggccctcagggactccctgacgcgacttctctggctccattctacgggaacacagcccactctgacccatcccgaccggacccaggcctgtagatgaggctgactattactgtcagggcgtgggacagcagcacgtgaggtgtcggacgggacgggaccgaaaggtccgtacgacccgtaccgtaacgtcgacgacccaggcctcggccccctccgg

SEQ ID NO: 403984 - DNA, 557 bp, Homo sapiens
  misc_feature: GZ8MTXP02I0WHN.4.59.F04.1.454.CMB.2.raw
  modified_base (234)..(234): a, c, t, g, unknown or other
  modified_base (315)..(315): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcatagtgttctctgagctggatccggcagcccccagggaaggactggagtggattggccatatctcttacagtgggancaccaactacaacccctccctcaagacgtcgtgtcaccgtgtcaatgacacgtccaagaccagttctccctgagctgagctctgtcgaccgccgcggacacggccgtgttatttcgtgtgcgagattctttcgtatttttgggagttcggtaaaccccctttgggtccttacgtcgggggcctaaggggaaccctcgggtccaccggttctcgttcacgccctccaccgaacgggccctacg

SEQ ID NO: 403985 - DNA, 614 bp, Homo sapiens
  misc_feature: GZ8MTXP02GD2RZ.4.59.F04.1.454.CMB.2.raw
  modified_base (234)..(234): a, c, t, g, unknown or other
  modified_base (390)..(390): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtgtttctctggagctggatccggcacgcccccgagggaaggactggagtggattggccatatctcttacagtgggagcaccaactaccaacccctcctcaagacgtcgtgtcaccgtgtcaatcgacacgtccaagaccagttccnccctgacggtctgagctctgtcgaccgcgcgacacggccgtgtactttcgtgtgacgagacttctttcgtagtttttgggacgttcgggttaaacccccgttggtaccgttacggttcgggggtaccctaacgggggtaaaccccttcggggtaccctacccggttccttccgtttccgaaccggtccccttacccgaacccgaaacggggtcccccttaacgg

SEQ ID NO: 403986 - DNA, 516 bp, Homo sapiens
  misc_feature: GZ8MTXP02G5SE9.4.59.F04.1.454.CMB.2.raw
  modified_base (332)..(332): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaatggcataattgcttctggtatcagcagagccaggccagtcccctatactggtcatctatacaagataccaagccggccctcgagggatccctgacgcgattcnctgctcattctagggaacacgagccactctagaccatccgaccgggacccaggcctagacgatgaggctagactattacgtgtcgtaggcgtgggacagcagcacgtgaggtcgttcgggacggaggaccgaagcgtacgaccgtccgtaacgtcgaccgccgaacggccgtccgccccgtcgg

SEQ ID NO: 403987 - DNA, 557 bp, Homo sapiens
  misc_feature: GZ8MTXP02G3VNV.4.59.F04.1.454.CMB.2.raw
  modified_base (314)..(314): a, c, t, g, unknown or other
  modified_base (342)..(342): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaaggactggagtggattggccatatctcttacngtgggagcaccaactacaacccctcccncaagacgtcgtgtcaccgtgtcaatgacacgtccaagaaccagttcctccctgagctgagctctgtgaccgccgcggacacggccgtgtatttcgtgtgcgagattctttcgtattttggagttcggtaaccccttggtactacgttggggccctaggggaaccctggtaccaccggttctcgttcacggtccctaccaccgaacgggccctacg

SEQ ID NO: 403988 - DNA, 493 bp, Homo sapiens
  misc_feature: GZ8MTXP02JC2S9.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaattgcttcctggtatcagcagaagccaggccagtcccctatactggtcatctatcaagataccaagcggccctcagggatccctgagcgattctctggctccaattctgggaacacagccactctgaccatcaccgggacccagctgtagatgagctgactattactgtacaggcgtggacagcagcactgagtgtcggacggagggaccaaggctcgaccgtcgtacgtcgacgcccaaggcctcgcccccg

SEQ ID NO: 403989 - DNA, 506 bp, Homo sapiens
  misc_feature: GZ8MTXP02HHIQA.4.59.F04.1.454.CMB.2.raw
  modified_base (338)..(338): a, c, t, g, unknown or other
  modified_base (458)..(458): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaattgcttcctggtatcagcagagccaggccagtcccctatactggtcatctatcaagactaccaagccggccctcgagggactccctgacgcgattcnctgctcattctaggaacacagccactctcgaccatccgacccgggacccaggctagtacgatgaggctagacttaattactagtcagggcgtaggacagcagcacgtgacggtggtcggnggacggaccagctcgaccgtccaacgtcacgcccgagctccgccctcg

SEQ ID NO: 403990 - DNA, 624 bp, Homo sapiens
  misc_feature: GZ8MTXP02G5GBW.4.59.F04.1.454.CMB.2.raw
  modified_base (234)..(234): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtagtttctctggagctggatccggcacgcccccagggaaggactggagtggattggccatatctcttacagtgggagcaaccaactaccaaacccctccctacaagacgtcgtgtcaccgtgtacaatgacacgtaccaaagaaccagttcctccctgaggctgagctctgtcgaccgcgcggacacggccgtgtatttctgtgcgagtacttcgtttacgtagtttttgggagttccgggttaaacccccgttgggtaccgttacggttcgggggtacccgtaacgggggtaaccccgttcgggtacccgtacccggttccttaaccgtttccgaacggtccccttacccgaaacccgaaaccggggtcccctaaccgg

SEQ ID NO: 403991 - DNA, 666 bp, Homo sapiens
  misc_feature: GZ8MTXP02H65DR.4.59.F04.1.454.CMB.2.raw
  modified_base (228)..(228): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgcccaccctcagtcgtccgtcgtccccaggacagacagccggcatcaccttctctgganaataaagttggacctaattaaattgcttcgtggtatcagcagaacgccaacgccacgtcccctatacgtggtcatctatacaagactaaccaagcacgccctacgacgggactccgtgacgccgtattcctcgtcggtcctccgtaagttcgtacggggaaaccaccgacgccctactacctacgaccactaccgaaccggaaccggacccgacggtacgtacggtagtaccccccccccccgtaggacggtacgtacgtaacgttacgttacgttacggtacggacgggtacgggacgggacggacgacgacgacgtacggtacggtacgggttacgggttacggggacggggaacgggaaccggaacggtaccggtaccggtaacccggtacccggtaccgtaccgaccggacccggaccggtacccggtccccgg

SEQ ID NO: 403992 - DNA, 555 bp, Homo sapiens
  misc_feature: GZ8MTXP02F5DZR.4.59.F04.1.454.CMB.2.raw
  modified_base (234)..(234): a, c, t, g, unknown or other
  modified_base (388)..(388): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtgtttctctggagctggatccggcagcccccagggaaggactggagtggattggccatatctcttacagtgggagcaccaactaccaacccctcctacaagacgtcgtgtcaccgtgtcaatgacacgtccaagaaccagttcnccctgaggctgacgctctgtcgaccgccgcggacacggccgtgtatttcgtgtgcgagtacttcgtttcgtatttttgggagttcggtaaaccccgttggctacgtcggggcctacgggaaccctcggtacgaccgtctcgttcgacgtcctccacgacggcctacg

SEQ ID NO: 403993 - DNA, 619 bp, Homo sapiens
  misc_feature: GZ8MTXP02IHWU8.4.59.F04.1.454.CMB.2.raw
  modified_base (235)..(235): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtagtttctctgagctggatccggcagccccgagggaaggactggagtggattggccatatctcttacagtgggagacaccaactaccaacccctccctacaagacgtcgtcgtcaccgtgtcaatagacacgtccaaagaaccagttacctcccgtgacggctgacgctactgtcgaccgcgcggacacggccgtagttatttcgtgtcgcgtagtattcgtttacgtagtttttggagttaccggtaaacccccgtttgggtaccttacggttcgggggacctaacgggggtaaaccccttcgggtaccgttacccgttcttaaccgtttcgaccggtcccttacccgacccgaaacggggtcccctaaccgg

SEQ ID NO: 403994 - DNA, 601 bp, Homo sapiens
  misc_feature: GZ8MTXP02J2G9M.4.59.F04.1.454.CMB.2.raw
  modified_base (235)..(235): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtgtttctctggagctggatccggcacgcccccagggaacggactggagtggattggccatatctctacagtggagcaccaactacaacccctcctacaagcgtcgtgtcaccgtgcaatcgacacgtaccaagaaccagttcctcccgtgaggctgacgctcgtgtcgaccgcgcggacacggccgtagtacttcgtgtcgacgtagtacttcgtttacgtagtttttcggacgttacggtaaacccccgttggtccgtaacggtcgggggacccgtaacggggtaacccgtcggggtacctacccggttctccgttccgacggtcccctacccgacccgaacgggccctaaccgg

SEQ ID NO: 403995 - DNA, 526 bp, Homo sapiens
  misc_feature: GZ8MTXP02GULG4.4.59.F04.1.454.CMB.2.raw
  modified_base (450)..(450): a, c, t, g, unknown or other
  modified_base (517)..(517): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataatggccataaatttgcttcctggtatcagcagaagccaggccagtcccctatactggtcatctatcaagatacccaagccggcccctgagggactccctgagcgattctctggctccgaattcgtacggggaactacgagcccacgtcctgacccataccgacccgggacccaggcctgtacgagtgaggctgaacttagttacctgtcgaggcgtagggacngcagcacgtggagtcggttcgggcggaggaccaagctacggaccgtcgtacgcacgccgaacggccncgtcccccg

SEQ ID NO: 403996 - DNA, 554 bp, Homo sapiens
  misc_feature: GZ8MTXP02IYN3O.4.59.F04.1.454.CMB.2.raw
  modified_base (235)..(235): a, c, t, g, unknown or other
  modified_base (440)..(440): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagacccctgtccctcacctgcactgtctctggtnactccataagtgtttctctggagctggatccggcagcccccagggaaggactggagtggaattggccatatctcttacagtggagcaccaactaccaacccctcccacaacgacgtcgtgtcaccgtgtacaatagacaacgtaccaaagaaccagtctaccctgaacgctgagctctgtcgaccgcgcgacgacgaccgtcgtnttacgttgtgtcgagatcttcgttagtttagttgtaggtacccttaccggtgtactcgggtcggacggtaccggtacgtcgacctcgtctctacaccgtcaccaacgacgaccg

SEQ ID NO: 403997 - DNA, 636 bp, Homo sapiens
  misc_feature: GZ8MTXP02HCICW.4.59.F04.1.454.CMB.2.raw
  modified_base (234)..(234): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagttgtttcttctggagctggatccggcacgcccccgagggaagggactggagtggatttggccatatctctacagtggagccaccaactaccaaccccctcctacaagcgtcgtgtcaccgtgacaatacgacacgtaccaaagaaccctagttcctccctgacggctgagctcgtgtcgaccgccgcgacaccggccgtgtatttcgtgtgcgagtattccgtttagtagtttttacgggacgtttaccgggtaacccccttgggtaccgttaccggtcgggggtcccgtaaacggggtaacccccgttacggggtccctaacccggtttcttccgtttaccgaaccggtccccttacccgaacccccgaaacgggggtccccctaaccggg

SEQ ID NO: 403998 - DNA, 492 bp, Homo sapiens
  misc_feature: GZ8MTXP02FVWFE.4.59.F04.1.454.CMB.2.raw
  modified_base (483)..(483): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggcctcagggatccctgacgcgattctctggctccattctggggaacacagccactctgaccatcaccgggacccaggctgtacgatgaggctgactattactgtcaggcgtgggacagcagcacgtgacggtgtcggcggagggaccaagctcgaccgtcaacgtcagccagcncgccctcgg

SEQ ID NO: 403999 - DNA, 588 bp, Homo sapiens
  misc_feature: GZ8MTXP02IH05W.4.59.F04.1.454.CMB.2.raw
  modified_base (238)..(238): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcagggagtcgggcccaggactggtgaagcctttcgggagaccctgtccctcacctgcactgtctctggtnactcattaagtagtttcttctggagctggatccggcacgcccccagggaaggactggagtggattggccatatctcttacagtgggagcaccaaactaccaacccctcctacaagacgtcgtgtcacgtgtcaatgacacgtaccaagaacccagttctccctagagctgagctctgtcgaccgcgcgacacgccgtgttattcgtgtgcgagacttcgtttcgtatttttcggagttacgttaacccccgttggtaccttacggttcggggacctaacggggaaccccgttgggtacctaccggttctaactttcgacgtcccttacccaccgaacgggccctaaccgg

SEQ ID NO: 404000 - DNA, 554 bp, Homo sapiens
  misc_feature: GZ8MTXP02G4Q0Z.4.59.F04.1.454.CMB.2.raw
  modified_base (385)..(385): a, c, t, g, unknown or other
  modified_base (441)..(441): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactcataagtgtttctctgagctggatccggcacgcccccgagggaaggactggagtggattggccatatctcttacagtggagcaccaactacaacccctcctcaacgacgtcgtgtcacgtgtacaatgacacgtaccaagaccagtcnccctgagctgagctcgtgtcgaccgcgcgacgacggccgtgtacttcgtgtgcganattctttcgtattttggagttcgtaaccccttggctacgtggggacccagggtaaccctgggtacctaccggtctcgttccacggtcccctacgacccgaacgggtccctacg

SEQ ID NO: 404001 - DNA, 526 bp, Homo sapiens
  misc_feature: GZ8MTXP02G1NSL.4.59.F04.1.454.CMB.2.raw
  modified_base (224)..(224): a, c, t, g, unknown or other
  modified_base (327)..(327): a, c, t, g, unknown or other
  modified_base (339)..(339): a, c, t, g, unknown or other
  modified_base (464)..(464): a, c, t, g, unknown or other
  modified_base (517)..(517): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgganataattggaccataaattgcttcctggtatcagcagaagccaggccacgtcccctatactggtcatctatcaagactaccaagccggcctacgacggactccngacgcgtattcncgtggctccgtaattcgtagggaaaccacaacgccactctacgacccatacccgacccgggacccaggtcctagtagatggagtctagaacttattaacctgtcgaggcgtgggacagcagcagngaggtgtcggacgaggacacgctacgacctcgtacgacgacgaccgacggccncgtcccccg

SEQ ID NO: 404002 - DNA, 640 bp, Homo sapiens
  misc_feature: GZ8MTXP02GIF8R.4.59.F04.1.454.CMB.2.raw
  modified_base (235)..(235): a, c, t, g, unknown or other
  modified_base (394)..(394): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtagtttcttctggagctggatccggcacgccccgagggaaggactggagtggattggccatatctcttacagtggagcaccaactaccaacccctcctacaagacgtcgtcgtcaccgtgtacaatgacacgtacaagaaccagttccnccctgacggctgagctcgtcgtcgaccgccgcgacgacggccgtgtactttcgtagtcgcgtagtacttcgtttacgttagtttttcgggacgtttacgggttaaacccccgtttgggtaccgttacgggttcgggggtacccgtaaacgggggtaaaccccgttcgggttacccgtaacccggtttccttccgtttccgaaccgtccccgttacccgaacccggaaccggggtccccttaaccgg

SEQ ID NO: 404003 - DNA, 676 bp, Homo sapiens
  misc_feature: GZ8MTXP02HXLY2.4.59.F04.1.454.CMB.2.raw
  modified_base (203)..(203): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcgganaccctgtccctcacctgcactgtctctggtgactccaataagttagtttctctggagctggatccggcacgcccccagggaaggactggagtggattggccagtatctcgttacagtggagcaaccgaactacaaacccctcctacaagacgtcgtacgtcaccgtgtacaaatcgacaacgtcccaaagaaccctagttacctccctagtaacggcctagacgcctctggtacgacccgacccggaccgggacgaaccggccgttacgttacgttttccgtgttcgaccggaggtattcgtttacgtagtttttcgggacgttaccgggtttaaacccccgttgggtaccgttacgggtcgggggtaccctaaacgggggtaacccccttcggggtaccctaacccgggttccttccgttacccgtacggtaccccttcccgaaaccccgaaacggggtccccttaacccgg

SEQ ID NO: 404004 - DNA, 556 bp, Homo sapiens
  misc_feature: GZ8MTXP02I4ZE0.4.59.F04.1.454.CMB.2.raw
  modified_base (236)..(236): a, c, t, g, unknown or other
  modified_base (247)..(247): a, c, t, g, unknown or other
  modified_base (409)..(409): a, c, t, g, unknown or other
  modified_base (442)..(442): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagacccctgtcccctcacctgcactgtctctggtnactcataagtntttctctggagctggatccggcagcccccagggaaggactggagtggattggccatatctcttacagtgggagcaccaactaccaaacccctcctacaagacgtcgtgtcaccgtgtacaatgacacgtaccaagaacctagttctacactgagctgagctntgtcgaccgccgcgacacggccgtgtactttcngtcgacgagacttcgtttcgtattttggacgttcggtaaccccttggactacgtcggggaccacgggtaccctggtaccaccgtctcttcgacgccctaccaccgaacggcccc

SEQ ID NO: 404005 - DNA, 505 bp, Homo sapiens
  misc_feature: GZ8MTXP02HXXP8.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctgganataattggccataaattgcttcctggtatcagcagaagccaggcccagtcccctatactggtcatctatcaagataccaagccgccctcgagggactcccgtgagccgtattctcgtcggctccgaaattcgtagggaacacacgaccactctacgacccatccgaacccgggcccaggcctgtagatgagctgacttattactgtcaggcgtgggacagcagcacgtgaggtgtcggcggaggaccagctgaccgtcacgtcacgccacggctcgccccg

SEQ ID NO: 404006 - DNA, 593 bp, Homo sapiens
  misc_feature: GZ8MTXP02JMRD8.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaagttgggaccattaaatttgcttcctggtatcagcagaagccaggccagtcccctatactggtcatctatcaagactaccaagcgccctcgagggactcccgtgacgcgtacttctctcggcctcctaattcgtaggggaaccacacgacccactctacgacccagtaccgacccgggacccgaggcctaggtacgataggacggacgtacgaacttacgttaccgtggtacgaggtcgggtagggaccaggacgacgacgacgtgggtacgggttcgggttacgggacgggacgggaccaacggtcgtacggacccgtccgtaccggtccgaacggcccgaaacggtccgtaccgtccccccgg

SEQ ID NO: 404007 - DNA, 577 bp, Homo sapiens
  misc_feature: GZ8MTXP02IA6AC.4.59.F04.1.454.CMB.2.raw
  modified_base (206)..(206): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggccccaggactggtgaagccttcggganaccctgtccctcacctgcactgtctctggtgactccataagttagtttctctggagctggatccggcacgcccccaggggaaggactggagtggattggccagtatctcttacagtgggagcaccaactaccaaacccctccctacaagacgtcgtgtcaccgtgtacaatgacacgtaccaaacgaccagttctccctagacgctgacgctctgtcgaccgcgcggacacggcgtgttacttcgtgtgcgagtacttctttacgtatttttgggagttcggttaacccccgttggtctacggtcggggcctacgggaacccttcggacctacccgtctcgttcacgcctacccgaccgacggccctaccg

SEQ ID NO: 404008 - DNA, 643 bp, Homo sapiens
  misc_feature: GZ8MTXP02HSVOF.4.59.F04.1.454.CMB.2.raw
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagttagtttctctggagctggatccggcacgccccgagggaaggctggagtggattggccatatctcttacagtgggagcaccaactaccaaacccctcctacaagcgtcgtcgtcaccgtgtaccaatgacacgtaccaaacgaaccagtcctaccctgacgctgacgctcgtgtcgaccgccgacggacgacggccgttgtactttcgtgtgcgagtattctttacgtagtttttgggacgttaccgggttaaaccccctttgggtaccgttaaccgggttcgggggtacccgtaaacgggggtaaacccccgttcggggtacccgtaacccggttccttccgtttaccgaaccggtccccttacccgaaccccgtaacggggtacccccttacccgg

SEQ ID NO: 404009 - DNA, 408 bp, Homo sapiens
  misc_feature: GZ8MTXP02FS2I2.4.59.F04.1.454.CMB.2.raw
  modified_base (319)..(319): a, c, t, g, unknown or other
  modified_base (383)..(383): a, c, t, g, unknown or other
  modified_base (398)..(398): a, c, t, g, unknown or other
  modified_base (404)..(408): a, c, t, g, unknown or other
tcagagcactgtagcacgaccggtgctcgatttagtacacacacttagggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctactggggccagggaaccctggtcaccgtctcttcagccctccaccaaggcccatcggtcttccccctggcacccctcctccaagngcacctctggggcacagcggccctgggctgcctggtcaaggctaccttccctacagtgctctgngcgggctggcaggcncatagnnnnn

SEQ ID NO: 404010 - DNA, 658 bp, Homo sapiens
  misc_feature: GZ8MTXP02IJTQL.4.59.F04.1.454.CMB.2.raw
  modified_base (235)..(235): a, c, t, g, unknown or other
  modified_base (260)..(260): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagttgtttctcgtggancgtggactccggcacgccccgagggaacggacgtggagtggattggcctatatctacgttacgaggtgggacaccaaccaaacctacccaaaccccctcctacgaacgaccgtaccgtcgtccaccgtagtacaaatacgactaacgtaccaaacgtaaccctacgttacctcccgtagacgcctagacgtctcgtgtccgacccggccgacgggaccgaccgggtccgttagttacgttttccgtggtcgacggtagtacgtttccgtttacgttaggtttttcggacgtttaccggtaccccgttggtaccgtacggttcggggacctaacggggtacctcggtacctaccggtcttccgtacgaccgtccctaccgacccgtaacggtccctacg

SEQ ID NO: 404011 - DNA, 598 bp, Homo sapiens
  misc_feature: GZ8MTXP02IU39F.4.59.F04.1.454.CMB.2.raw
  modified_base (401)..(401): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatccacctgctctggagattaaagttgggacctaagttaaatttgtacctttccgttaggtactcaggccaagaacgcccacgggcccacggtaccccctataccgtggtcactctatcaaagactacccgaagccggcccctagacgggactcctgacgcgtacttctctaggctcctattctacgggaacncagccactcacgaccatccgacccggacccagcctagtagactgagctacgtactaattacgtgtcgaggcgtaggggactaggcagacgacgtgggtacgggtcggttacgggacggggtaacgggaaccgacgtaccgtacggtacccgtaacgtaccgtacgaccggaccgaacggtccgtacccgtcccccgg

SEQ ID NO: 404012 - DNA, 706 bp, Homo sapiens
  misc_feature: GZ8MTXP02HY5R2.4.59.F04.1.454.CMB.2.raw
  modified_base (177)..(177): a, c, t, g, unknown or other
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctnagtgtccgtgtccccaggacagacagccggcatcacctgctctgganataaatggcaataattgcttctggtatcagcagaagccaggcccagtcccctatactggtcatctatcaagactaccaagccggccctcgagggactcccgtgacgtcgtattcctcgtcggcctcctaaatttcgacggggaaccacgacgccctaactctacgaccctagtcccgaacccggggacccaagggcctaggtaacgagttcggaaggtccttaggaaccttagtttaaccgtggttacgaacggggtccggttagggggaaaccagggacccgaaaggccgtaaaccggttcggggtaaaacgggggttttcggggtttaaaccccgggggaaccgggggtaaacggggggtaaacccccaaaaggggtccccgttaccggggaaaacccccggtttcccgtttaacccgggtaccgaaccgggtaccccccgaaaaggggtcccccgttaccccggttcccccccccgggg

SEQ ID NO: 404013 - DNA, 501 bp, Homo sapiens
  misc_feature: GZ8MTXP02F7OJ4.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataatggccataattgcttcctggtatcagcagagccaggccagtcccctatactggtcatctatcaagatacccaagcggccctcagggatccctgagcgattctctggctccaattctagggaaccacacgccactctgaccatcgacccgggacccaggctgtagatgagctgactattactgtcgaggcgtagggacagcagcgacgtggacggtgtcgggcgggaggaccgagcgtgaccgtcgtacgtcacgcccacggcctcgtcccccg

SEQ ID NO: 404014 - DNA, 552 bp, Homo sapiens
  misc_feature: GZ8MTXP02H5Z31.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcatccaccctcagtgtccgtgtccccaggacagacagccggcatcacctgctctgganataaattggccaataaattgcttcctggtatcagcagagccaggccagtcccctatactggtcatctatcaagataccaagcgccctgaggactcctgagcgattctctggctccaattctagggaacacacgccactctacgaccatccgacccgggacccaggtcctagtaagagttggaggtctagtaacttagttactggtacgagggccgtagggacagcagcacgtggaggtcggttacgggcgggtaacgggacctaacggccgtacggacccgtaaccgtaccggtaccacggacccgaacgggcctaccggtccccccg

SEQ ID NO: 404015 - DNA, 547 bp, Homo sapiens
  misc_feature: GZ8MTXP02I8HD6.4.59.F04.1.454.CMB.2.raw
  modified_base (234)..(234): a, c, t, g, unknown or other
  modified_base (446)..(446): a, c, t, g, unknown or other
  modified_base (530)..(530): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggcgcagctgcaggagtcgggcccaggactggtgaagccttcggagaccctgtccctcacctgcactgtctctggtnactccataagtgtttctctggagctggatccggcacgcccccagggaacggactggagtggattggccatatctctacagtggagcaccaactacaacccctcctacaagacgtcgtgtcacgtgacaatagacacgtaccaaagaacctacgttcctccctgacgtctagacgctcgtgtcgaccgcgcgacacggtccgtgtactttcgngtgcgagtattcgtttcgtagttttggacgttcgtacccctggtctacgtcgggacacggtacctcggtccacgtctcgtcacncctacacacggcctacg

SEQ ID NO: 404016 - DNA, 691 bp, Homo sapiens
  misc_feature: GZ8MTXP02IA7ZA.4.59.F04.1.454.CMB.2.raw
  modified_base (387)..(387): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccaataagttagtttcttcgtggagctggactccggcacgcccccgaaggggaacgggacgtggagtggagtttggacctagttactcttactacgaggtgggacgcaaccaactaccaacccctcctacaagacgtcgtgtacacgtntacaatacgaacacgtaccaacgaacctacgttacctaccctagtacggctgacgctacgtcggtacgacccgccggaccgggaccaaccgggcccgttagttacgtttcgtggtgtaccgagtacgtttcgtttacgttagtttttacgggacgttaccggtttaacccccgttgggtacccttacgggttccgggggaaccgtaaccggggtaaaccccgttcgggttacccgtaacccgtttccgttcccgttccggaccgtccccgtaccccgaacccggtaccgggtacccctacccgg

SEQ ID NO: 404017 - DNA, 568 bp, Homo sapiens
  misc_feature: GZ8MTXP02HG6VT.4.59.F04.1.454.CMB.2.raw
  modified_base (443)..(443): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattggacataaattgcttcctggtatcagcagaagccaggccagtcccctatactggtcatctatcaagactaaccaagcggccctgagggactcccgtgagcgtacttctcgtcggctcctaaatttcgtagggaaaccacgacgacccactctacgacccactcccgacccgggacccaggctacgtagagtgacggtctagacttattacgngtacgaggcgtagggacagcgagacgacgtggaggtcggttcgggacgggacggggaacctaacggcctacggaccccgtaaccgtacgtaccacggaccccgaacggcccttaccggccccccg

SEQ ID NO: 404018 - DNA, 607 bp, Homo sapiens
  misc_feature: GZ8MTXP02FQLSD.4.59.F04.1.454.CMB.2.raw
  modified_base (235)..(235): a, c, t, g, unknown or other
  modified_base (246)..(246): a, c, t, g, unknown or other
  modified_base (303)..(303): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcataagtnttctctgagctggatccggcacgccccgagggaggactggagtggatggcatatctntacagtggagcaccaacgtaccaacccctcctacaagacgtcgtctcacgtgacaatcgacacgtacaacgacctagtcctcctgagtctgacgtctctgtcgacccgcgacgacgacggtccttgttactttcgtgtcgtacggatacgttctttacggtagtttttacgggacgtttaccggttaacccccgttgggtaccttacgggtcggggaccgtaacggggtaacccgttgggtaccctaccggttcctccgtttaccgacgaccccttacccgaaccgaaccggggtccctaccgg

SEQ ID NO: 404019 - DNA, 661 bp, Homo sapiens
  misc_feature: GZ8MTXP02GDEFD.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagaataaattggacctaattaaattgcttctggtatcagcagaagccaggccacgtcccctatactggtacatctatacaagactaccgaagccggaccctcgaggactccctgacgtcgtacttctcgtcggtcctccgtaatttcggacgggaaaccacgtaacgccctacctccgtacgaacccacgtacccgaacccggggaccctaagggccttaggtaacgagttacggacggtacgttacgtaacgttaacgttaacgtggttaccggaaggggtcccggttaggggaacgacggaccgaagccgtaacgtggggtaacgggttcgggttaccgggggacggggaaacgggaccgaacggtaccgtaccggtaacccgttcccgtaaccggtacgaccggacccgaacgggtcccgtacccggttcccccgg

SEQ ID NO: 404020 - DNA, 511 bp, Homo sapiens
  misc_feature: GZ8MTXP02IZ5R2.4.59.F04.1.454.CMB.2.raw
  modified_base (331)..(331): a, c, t, g, unknown or other
  modified_base (429)..(429): a, c, t, g, unknown or other
  modified_base (452)..(452): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataatggccataattgcttcctggtatcagcagagccaggccagtccccatactggtcatctatcaagataccaagccgcctcgagggactccctgacgcgattctntggccttcattctagggaacacgagcccactctcgaccatcccgaccggaccaggctgtagatggagctagacttattactgtacagggcgtgggacnggcagcagtgaggttcgtcgggnggacgggaccagcgtacgacccgtcgtaacgtcgacgacccaggccctcggcccctcgg

SEQ ID NO: 404021 - DNA, 567 bp, Homo sapiens
  misc_feature: GZ8MTXP02GUH2X.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtcgtccccaggacagacagccggcatccaccttctctggagtataaagttcggactaattaaattgcttctggtatcagcagacgccaggccacgtcccctatacgtgtacatctatacaagactaccaagccgcctcgaggctccgtgaccgcgtattctctcggacctactacgttcgagggaaaccacgacgccactcctacgaccacgtcccgacccggaccgagctagagagtgagctagtacttattacgtgtcgagggtcgaggacagcgaagctacgtggtacggtcggtacggggacggacggaacacggtccgtacggtacccgtaccgtaacgacccgacgacccgacgtcccgtcccgtaccccggtcg

SEQ ID NO: 404022 - DNA, 711 bp, Homo sapiens
  misc_feature: GZ8MTXP02HDZO5.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctcgtggcctcctatgaggtgactcagccaccctcagtgtccgtgtccccaggacagacagccggcatcacctgctctggagataaagttggaccataatttgacttcctggtatcagtacagaagccaggccaggtccccctatactggtcatctatacaagataccgaaagcgccctacgagggactcctgacgcgtacttctcgtcggcttcctaaacgtttcgtacgggggaaacctaccgacggacccctaacttcccgttacgaacccctacgtaccccggaaccccgggggtaaacccccgacggggtacccgttagggttaaacgaacgttaggaacggggtaccttacggtaaaccttacgtttaccgtacggtaccggtacgggaccggttacgggggaacacggacgtaaggaccgtaaacgttccggtaaggggttcgggttaccgggggaccggggtaaacggggtaaacccgaagggtaccgtaccggtaaacccgtcccgtaaccggttacccgacggtaccccgaaacgggtacccgttcccggtacccccccg

SEQ ID NO: 404023 - DNA, 493 bp, Homo sapiens
  misc_feature: GZ8MTXP02FEQSM.4.59.F04.1.454.CMB.2.raw
  modified_base (394)..(394): a, c, t, g, unknown or other
  modified_base (411)..(411): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaatgggccataaattgcttctggtatcagcagaagccaggccagtcccctatactggtcatctatcaagataccaaagcggccctcagggatccctgagcgattctctggctccaaattctaggggaacacagccactctgaccatcaccgggacccaggctgtagntgaggctgactattacngtcaggcgtgggacagcagcactgatgtgttcggcggaggaccaagctagaaccgtctacgtcacgacccaaggctacccgg

SEQ ID NO: 404024 - DNA, 681 bp, Homo sapiens
  misc_feature: GZ8MTXP02H2D3Q.4.59.F04.1.454.CMB.2.raw
  modified_base (334)..(334): a, c, t, g, unknown or other
  modified_base (532)..(532): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaaggccttcgggagaccctgtccctcacctgcactgtctctggtgactccaataagttagtttctctggagctggactccggcacgccccgaggggaacggactgggagtggattggccagtatctacttacgaggtggganaccaacctaaacctacccaaaccccctcccaacgtaacgtaccgttaccgtttccaaccggttgttacaaagtaacgaccgaacgtacccaaacgaaccctaacgttcccacccgttagacgctagacgtccttcgtgtacgacccggtccgaaccgggaccgaccgggccgttagttactttcgtgtcgacgtagtnttacgttcgttagtttttcggacgttaccgttaccccgtgtaccttacgggtcgggtacccgtaacgggtaaacccgtcgggttaccgtacccggttctcttaaccgactaccctacccgaaccgaccggtaccctacggttcccccgg

SEQ ID NO: 404025 - DNA, 573 bp, Homo sapiens
  misc_feature: GZ8MTXP02IF7FJ.4.59.F04.1.454.CMB.2.raw
  modified_base (236)..(236): a, c, t, g, unknown or other
  modified_base (253)..(253): a, c, t, g, unknown or other
  modified_base (465)..(465): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcgggagaccctgtccctcacctgcactgtctctggtnactcataagtgttctcngagctggatccggcagcccccagggaggactggagtggattggccatatctcttacagtgggagccaccaactaccaaacccctcccctacaagacgttccgtttccaccgttgtacaaatacgacacgtcccaaaggaaaccctagttacctcccgtgaacggcttgagctctgtgacccgccgcggacacggcgtgtactttctgtgcgngattctttcgtatttttggagttcggttaaccccttggcttaacgtcggggccacgggaaccctggtcaccgtctcttcgacgcctccaccacggcccacgttcccgg

SEQ ID NO: 404026 - DNA, 712 bp, Homo sapiens
  misc_feature: GZ8MTXP02J1H5S.4.59.F04.1.454.CMB.2.raw
  modified_base (219)..(219): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagcccaccctcagtgtccgtgtccccaggacagacagccggcatcaccttcnctggagataaatggaccattaaatttgcttcctggtatcagcagaagcccaggccacgtcccctatacgtggtcatctatacaagactaacccaaggccggccctagacgggactcccgtagacgcgtattcctcgtcggcctactacgttcgtacgggaaccacgacgcccaacttcgtaccgtaccacgtacccgaacccggggacccagggtccgtaggtaagtagtcgggacggtccgttaacgtaacgttacttaaccggtgttacccggtaggggaccggtagggaaccgacggaccgttaaacggccgtacggtacgggtacggggttacggggtttacccgggggacgggggtaaacccgggtaaacccggtaaagggcccgttaacccgggtaccccgttaaccccggttaaccgggttaacccgaacccggaacccccggaaaggggtccccccgtaaccccggtaccccccgtttacccggg

SEQ ID NO: 404027 - DNA, 551 bp, Homo sapiens
  misc_feature: GZ8MTXP02GRCM0.4.59.F04.1.454.CMB.2.raw
  modified_base (223)..(223): a, c, t, g, unknown or other
  modified_base (419)..(419): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctganataatggcataattgctcctggtatcagcagagccaggccagtcccctatactggtcatctatcaagataccaagccggccctagaggactccgtgagcgtattctctggcctcaattcgagggtaacacgagccaactctgacccagtaccacccgggacccaggcctaggtagaatggacgctagactattacngtacgaggcgtagggacacgcagctacgtggtagggttacggttcgggacgggtaacggggaccaaaggtccgtacggtacccgtcccgtacgtaccgacggaccccgtaacggcccgtacccggtcccccg

SEQ ID NO: 404028 - DNA, 539 bp, Homo sapiens
  misc_feature: GZ8MTXP02GEZGQ.4.59.F04.1.454.CMB.2.raw
  modified_base (246)..(246): a, c, t, g, unknown or other
  modified_base (280)..(280): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaatggcataaattgcttcnggtatcagcagaagccaggccagtcccctatacncggtcatcatcaagataccaagccggccctcgagggactcccgtagacgcgattctcgtcggctccgaaattctaggggaaccacacgccaactcctagaacccataccgacccggggacccagggcctagtaacgatgaggctaggacttagttactgtcaggtcgtagggacaggcagtcgaacgtggaggtcggttcggacgggacgggaccaaagcgtagacccgtcgtacgcacggccaaggctacggcccccg

SEQ ID NO: 404029 - DNA, 706 bp, Homo sapiens
  misc_feature: GZ8MTXP02FHBWU.4.59.F04.1.454.CMB.2.raw
  modified_base (225)..(225): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtcgtccccaggacagacagccggcatcaccttctctgganataaattggactataattgcttctgtatcagacagacgccaggccacgtccccgtatactggtcactactatacaagactaccgaagccggaccctagacgggactccccgtagaccgtacgtacttcgtcctacggtcctaccgtacttccgacgggaaaccacgtacgacctacctacgttaccgaaccctaccgtacccggaacccgggtacccgagggtacccgtaggtaacggtagttcggaacgggtcttacggtaaaccttagtttaacgtcgggttaccgacggggtaccggtacggggaaacctacggacgttaacggaccgtacggttagggtaacgggggttcgggttaccgggggacgggtaaaaccggggaccaaacggtccggttaaccgaccccgtttaccgtaaacgggtacccgaacccggaccccgtaacgggtaccgttcccccggccccggtttaacccgg

SEQ ID NO: 404030 - DNA, 572 bp, Homo sapiens
  misc_feature: GZ8MTXP02HYC11.4.59.F04.1.454.CMB.2.raw
  modified_base (235)..(235): a, c, t, g, unknown or other
  modified_base (480)..(480): a, c, t, g, unknown or other
  modified_base (494)..(494): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactccataagtgtttctctggagctggatccggcacgcccccaggggaacggactgggagtggatttggcctatacgtctcttacaggtgggagcaaccaactaccaacccctccctacaagtacgtcgtgtcaccgtgtacaatcgacacgtaccaaacgtaacctacgttcctccctagacggctgacgtctcgtcgtcgacccgccgcggacgacggccgttggtatttcgtgtgcgtagtntcttcgtgtttggngttcgtacccctggctacggtcgggccacgggtacctcgtccgaccgtctcgttcacgcctacaccgtacggcctacg

SEQ ID NO: 404031 - DNA, 532 bp, Homo sapiens
  misc_feature: GZ8MTXP02FFJTR.4.59.F04.1.454.CMB.2.raw
  modified_base (399)..(399): a, c, t, g, unknown or other
  modified_base (434)..(434): a, c, t, g, unknown or other
  modified_base (522)..(522): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagactaccaagccggccctcgacggggatccccgtgacgcgtattctcgtggcctctatcgtagggaacacagccactctgaccatcgacccggaccaggcngtagactgacgtcagactattacctgtcgacgggngtcgggacagcgacgcacgtggtagggtcgttacggggcgggaacgggaccaagcgtacgacccgtcgtaacgcacggcccgaggccncgccccgtcg

SEQ ID NO: 404032 - DNA, 690 bp, Homo sapiens
  misc_feature: GZ8MTXP02GCW1H.4.59.F04.1.454.CMB.2.raw
  modified_base (463)..(463): a, c, t, g, unknown or other
tcagagcactgtagcacgaccggtgctcgatttagtacacacacttagggattggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctcgtggtgactccattaagtgtttctctggagctggatccggcacgccccgagggaaggactggagtggatggccagtactctctacgagtggagcaccaactaccaacccctccctacaacgacgtcgtcgtcaccgtgtaccaatcggacacgtaccaaacgaaccagtttcctccctgacggccttagacgtctcgttcgtcgaccgccggcgaccgcggtcgtgtatttcgnggttcgacgtagtacgttcgtttacggttagtttttacgggacgtttacccgggtttaaacccccgttgggttacccgttaacgggttccggggggtaccccgttaaacgggggtaaacccccttcgggggttacccctaaacccggggtttccttccggttttacccgaacggtaccccccgtttacccgaaaccccggaaacgggggttaccccctttaaccggg

SEQ ID NO: 404033 - DNA, 640 bp, Homo sapiens
  misc_feature: GZ8MTXP02GA209.4.59.F04.1.454.CMB.2.raw
  modified_base (235)..(235): a, c, t, g, unknown or other
  modified_base (245)..(245): a, c, t, g, unknown or other
  modified_base (250)..(250): a, c, t, g, unknown or other
  modified_base (252)..(253): a, c, t, g, unknown or other
  modified_base (256)..(256): a, c, t, g, unknown or other
  modified_base (260)..(260): a, c, t, g, unknown or other
  modified_base (272)..(272): a, c, t, g, unknown or other
  modified_base (301)..(301): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcatagtnttctngnntgncgcncgcccaggagcngagtgatggcatatctctacaggtggacncaccaactaccaacccctcctacaacgacgtcgtcgtcaccgtgtacaatacgacacgtaccaaagaacctagttcctcccgtgacgtctagagctcgtgtcgaccgccgcggaccgcggtccgttgtactttcgtagtcggacgtagtactttcgtttacgttagtttttacgggacgtttaccggttaacccccgttgggtaccgttaccgggttacgggggtacccggtaaaccggggtaacccggttcggttacccgtacccggtttcgttaacccgttaccgtaccggtacccccgtacccgtaacccggtaaaccgggtccccgttaacccgg

SEQ ID NO: 404034 - DNA, 580 bp, Homo sapiens
  misc_feature: GZ8MTXP02F8SSD.4.59.F04.1.454.CMB.2.raw
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctgganataatggcataattgcttctgtatcagcagagccaggccagtcccctatactgtcatctatcaagactaccaagccggccctcgagggactccctgacgcgtattctctggcctcctattcgtagggaaaccaccacgaccactactcgaccctagtcccgaacccggggacccaggcctaggtaacgagtcggagcctaggacttattacgtgttacgagggtcgtagggacaggacgacggcacgtggacgggttacggttcgggggacggtacgggggaaccaaacggccgtacggaacccgtttaccgaaccgtccgacgacccggaacggtccgcccggtcccccgtacgg

SEQ ID NO: 404035 - DNA, 579 bp, Homo sapiens
  misc_feature: GZ8MTXP02F9CBR.4.59.F04.1.454.CMB.2.raw
  modified_base (226)..(226): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtcgtccccaggacagacagccggcatcaccttctctgganataaagttggacctaataaatttgcttcctggtatcagcagagccaggccagtcccctatactggtcatctatcaagactaccagccgccctcgagggactcccgtgaccgcgtattctcgtggcctctagtccgtagggaaaccacacgccaactctacgaccactaccgacccggaccaggtcacggtagagtgacggctagacttatcgtgtcgagggcgtagggacaggcagcctagtaggtaggtcggtacggggacgggacgggaaccgaacggcgtacggtaccccgttacccgtaacggtacccaacggacccgaacgggccttacccggcccccgtttaccggg

SEQ ID NO: 404036 - DNA, 618 bp, Homo sapiens
  misc_feature: GZ8MTXP02INNMZ.4.59.F04.1.454.CMB.2.raw
  modified_base (204)..(204): a, c, t, g, unknown or other
  modified_base (235)..(235): a, c, t, g, unknown or other
  modified_base (251)..(251): a, c, t, g, unknown or other
  modified_base (254)..(254): a, c, t, g, unknown or other
  modified_base (352)..(352): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcgganaccctgtccctcacctgcactgtctctggtnactcatagtgttctcnganctggatcgcacgccccagggaggactggagtggatggcatatctctacagtggagcaccaactaccaacccctcctacaagacgtcgtgtccaccgtntacaatcgacaccggtaccaaagaaccctagttcctccctgagctagacgcttgtcgtcgacccgccggacggacgacggccgttagttactttcgtgtcggacgagtactttcgtttacggttagtttttcggacgtttacggttaaacccccgttgggtaccttacgggtcggggacccgtaacggggtaaccccgttcgggtaccctaccgttcgtcctttacaacgttccctaccgaacccgtaacggggccccttaaccgg

SEQ ID NO: 404037 - DNA, 604 bp, Homo sapiens
  misc_feature: GZ8MTXP02GSIUX.4.59.F04.1.454.CMB.2.raw
  modified_base (235)..(235): a, c, t, g, unknown or other
  modified_base (252)..(252): a, c, t, g, unknown or other
  modified_base (256)..(256): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtnactcataagtgtttctntganctgatcgcacgccccgagggaggactggagtggattggccatatctcttacgagtgggagcaaccaactaccaacccctcctacaacgcgtcgtcgtcacgtgtacaatacgacacgtaccaaagaaccagttcctaccctagagcctagacgtctcgtgtcgaccgcgcgacgacgcgtgtattcgtgtgcgtagtacttcgtttcgttagttttcggagttaccggttaaccccgtggtaccgttacggtcggggtacccgtaacggggtaaacccttcgggtaccctaccggttcctaaccgttcgaaccgtcccgtacccgaaccggtaaccggccctaaccgg

SEQ ID NO: 404038 - DNA, 622 bp, Homo sapiens
  misc_feature: GZ8MTXP02JHDPD.4.59.F04.1.454.CMB.2.raw
  modified_base (299)..(299): a, c, t, g, unknown or other
  modified_base (349)..(349): a, c, t, g, unknown or other
  modified_base (358)..(358): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtgtccgtgtccccaggacagacagccggcactcaccttctcgtggaagtaataaagttcgggacctaattaaatttgcttcctggtatcagcagagccagccacgtccctatacgtgtnatctatacaagactacgagccgtccacgaggctccgtgacgcgtattccntcgcttacngttcaggaaccacagaccactcgtacgacctacgtccgaaccggtaccaggtctaggtacgagtagacgtctaggtaaccttagttacgtacgtacgcgggtacgtacggggacacggccgaaggccgtaggtggaacgggttcggtaccggggcgggtaaacggggaccctacggggtacccttacgggaacccgttaccgttaaccggaccgaaccggtaccccgaacggtccccgttaaacccggtcccccgtttaaccgg

SEQ ID NO: 404039 - DNA, 610 bp, Homo sapiens
  misc_feature: GZ8MTXP02F2O2H.4.59.F04.1.454.CMB.2.raw
  modified_base (236)..(236): a, c, t, g, unknown or other
  modified_base (322)..(322): a, c, t, g, unknown or other
  modified_base (400)..(400): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcagggagtcgggcccaggactggtgaagccttcggagaccctgtccctcacctgcactgtctctggtnactccataagtagtttctctggagctggatccggcacgccccgagggaaggactggagtggattggcatatctcttacagtgggancaccaactacaacccctcctacaagacgtccgtgtacaccgtgacaagtacgacaccgtaccaaacgaaccagttccnccctgaggcctagacgtctcgtcgtcgaccgccgcggacgacggtccgtgtacttcgtgtgcgatattcgtttcgtagtttttcggagttaccggttaaccccgttggtaccgttacggtcggggtaccgaaacggggtacccgtcgggtacctacccgtttctccgtttaaccgcggtaccctcccgaaccgaacggtcccttaaccgg

SEQ ID NO: 404040 - DNA, 716 bp, Homo sapiens
  misc_feature: GZ8MTXP02F8SEI.4.59.F04.1.454.CMB.2.raw
  modified_base (324)..(324): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccattaagtgtttcttctggagctggatccggcagcccccgagggacggactggagtggattggccagtatctcttacagtgggancaccaacgtaccaacccctcctacaagaccgtacgtcgtcaccgtcgtacaatagtaccacgtaccaaaccgaacctaacgtttcctacccttagaacggtccgttagaacgcttccgtcgtacggtacccgccgccggaaccgccgggaccgtttacgttacgttttacgtcggttcgacggtacgtaacgtttccgtttaccggttagttttttcggggaacggttaccgggtttaaaaccccccggtttgggtaccgttttaaaccggtcgggggtaaccccgtaaacgggggttaaacccccgttcgggtaaccccgttcccgttaccgtccgtttcgaaccgggtccccttacccgaacccgtaaaccggggtcccctttaacccgg

SEQ ID NO: 404041 - DNA, 616 bp, Homo sapiens
  misc_feature: GZ8MTXP02FJ8O9.4.59.F04.1.454.CMB.2.raw
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactcataagtagtttctctggagctggatccggcagcccccgagggaaggactggagtggattggccatatctcttacagtgggagcaccaacctaccaacccctcctacaagacgtcgtgtcacgtgtacaatacacacgtacaacgaaccacgtctccctgacgctagagctctgtcgaccgcgcgacacggccgtgtattcgtgtcgacgtagtacgttctttacgtagtttttagggacggttccgggttaaacccccgttggtaccgttacggtccgggggtaccgtaacggggtaaaccccgtcggggttacctacccggttctaaccgttccgacggtcccctacccgacccggtaaacgggtcccctaaccgg

SEQ ID NO: 404042 - DNA, 516 bp, Homo sapiens
  misc_feature: GZ8MTXP02G4WXP.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaattgcttcctggtatcagaagaagccaggccagtcccctatactggtcatctatcaagataccaagcgccctcagggatcccctgagccgattctctggctccaattctgggaacacagccactctgaccatccaccggacccaggctgtacgatgaggctgactattactgtcagggcgtagggacagcagcacgtgaggtgttacggcgggagggaccaaagcgtcgacccgtcctacggtcacgacccgaaggcctcgcccccgtaggtcccg

SEQ ID NO: 404043 - DNA, 638 bp, Homo sapiens
  misc_feature: GZ8MTXP02IZNVY.4.59.F04.1.454.CMB.2.raw
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatccacctgctctggagataaagttgggacctaataaatttgcttcctggtatcagcagaagccaggccagtcccctatactggtcatctatcaagactaccagccgccctgagggactcccgtgacgcgtacttcctctcggcctccgtaattcgacggggtaaaccaccgagcccacttcctacgacccatacccgacccgggaccccagggtcctaggttaagatacggaggtacgtagtaacttacgtttaactggtacgagggtcgtacggggaactggaccgaggacccgtaacgtagggtacggggttcgggtttacggggacggggaacggggaacccgtaacgggacccgttacggacccgttaacccgtaccggttaccgaccggaccccggaaacggtcccgtacccggttccccccgg

SEQ ID NO: 404044 - DNA, 629 bp, Homo sapiens
  misc_feature: GZ8MTXP02F9FVS.4.59.F04.1.454.CMB.2.raw
  modified_base (495)..(495): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtcgtccccaggacagacagccggcatcacctgctcgtggagataaagtgggaccaattaaattgtcttcctggtactcagcagaacgccacggccacgtacccctatactggtactatctatacaagactaaccgaacgcggaccctcgacggtactccgtagacgtccgtattccgtacgtcggtcctacctaagtttcgtacgggaacctaccgacgaccccacttccgtacgaacccctacgtacccgaacccgggtacccgacggtccgtagtacgagttaggacgtctaggtacttattacgngtacgaggtcggagggacaggcacggactagtgggtacggtacgggtacggggacggtaacgggaccgacgtcccggacgtacccgtccgttaaacggccgaccggacccgacggtccccgtccgtacccccgg

SEQ ID NO: 404045 - DNA, 570 bp, Homo sapiens
  misc_feature: GZ8MTXP02HN4R9.4.59.F04.1.454.CMB.2.raw
  modified_base (177)..(177): a, c, t, g, unknown or other
  modified_base (207)..(207): a, c, t, g, unknown or other
  modified_base (216)..(216): a, c, t, g, unknown or other
  modified_base (242)..(242): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctnagtgtccgtgtccccaggacagacagccgnatcacttcnctggagataatggcataattgcttcnggtatcagcagagccagccacgtcccctatactggtacatctatacaagactaccaaagccggccctagacggggactccccgtaggacgtcggtactttcgtctggtcccttacctactttccgtaggggaaactacacgccactctacgaccagtccaccggggacccagcctagtacgatgaggactgacttattacgtgtacgaggcggtaggaaccgagacgtagacacgtggacggttcggtacggcgggacgggtaccaacggtctacggaccgtcgttaaccgcgaccgccgaaagggtccctccggaccccgttcccgg

SEQ ID NO: 404046 - DNA, 598 bp, Homo sapiens
  misc_feature: GZ8MTXP02GJRMY.4.59.F04.1.454.CMB.2.raw
  modified_base (225)..(225): a, c, t, g, unknown or other
  modified_base (475)..(475): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtcgtccgtcgtccccaggacagacagccgcatcaccttctctgganataaagttggactattaattgcttcctagtatcagcagaacgccagccacgtcccctatactgtcatctaatacaagtactaaccaacggccgccctacgaggtactcccgtagaccgtcgtattcgtcgtcgtccttactagtccgtacgggaaaccacgacgcccaacttcacgacctacgaccgaacccgggaccagtctacgtagacgtgacgtctagacttagtactgacgagggccgtaggacncgagacgctagtggacggtcgtaccggggagggtaccggaaaccgtagtcccggtaacgtaccccgtacgttaacgggaccaaccggaccccgtaaggttcccgaaccccgtccccggttccg

SEQ ID NO: 404047 - DNA, 614 bp, Homo sapiens
  misc_feature: GZ8MTXP02FLFYK.4.59.F04.1.454.CMB.2.raw
  modified_base (467)..(467): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagcccaccctcagtgtccgtgtccccaggacagacagccggcatcaccttctctggagataaattggccaataaattgcttcctggtatcagcagaagccaggccacgtcccctatactgtcatctatacaaagactaaccaagccggaccctacgacgggactcccgtagaccgtcgtattctacgtcggtcctacctatttcgacgggaacctaccgacgcctactctacgaccacgtacccgacccgggacccgaggtacctagtaagacgtaggacggtcttagaacttattacgngttacgagggtcggtacggacacgacgacgcgacgtggtacgggttcgggttacggggacgggaacgggtaccgaacggtccgtacggacccgttaccgaaccgtaccgaccggacccgaacggtccctcccggcccccgttaccgg

SEQ ID NO: 404048 - DNA, 540 bp, Homo sapiens
  misc_feature: GZ8MTXP02F4800.4.59.F04.1.454.CMB.2.raw
  modified_base (224)..(224): a, c, t, g, unknown or other
  modified_base (449)..(449): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctgganataaatggcataattgcttctggtatcagcagagccaggccagtcccctatactggtcatctatcaagataccaagccgccctacgagggactcccgtgacgcgtattctctggcctcctattcctaggggaaaccaccgagacccactctacgaccatacccgaacccgggacccaggctgtaacgagtagagctagactattacgtgtcgagggcgtagggangcgagcagtgaggtcgtcgggacggacggaccaacgcgtacgacccgtccgtaacgtccaacgacccgaacggcctccggaccccctccgg

SEQ ID NO: 404049 - DNA, 691 bp, Homo sapiens
  misc_feature: GZ8MTXP02JVTPP.4.59.F04.1.454.CMB.2.raw
  modified_base (388)..(388): a, c, t, g, unknown or other
  modified_base (415)..(415): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcagggagtcgggcccagggactggtgaagccttcggagacccctgtcccctcacctgcactgtctcgtggtcacctcaattagttagtttctcgtggacgtcgtggactccggcacggccccgaggggaacggcgtggagtggagttggcctatatctctacgaggtgggacactaaccaacctaccaacccctcctacaacgtcgtcgtcgtcacgttnacaatacgaccactaccgaagtaaccncgttcctacccgtagaacggtctacgacgtctcgtcgaccggacccggccggaccggaaccgtccggggtccgtttagttacgtttcggcgttacggaccgggttaattccgtttacgtttttacggtaaggttttttcgggaacggtttacccggtaaacccccgttggtaccggtaacggttcggggaccccgtaaggggtacccgtcggtacccgtaccgtttcgtaacgttcccgaccgttacccacggacccgtaacgggtcccctaccgg

SEQ ID NO: 404050 - DNA, 744 bp, Homo sapiens
  misc_feature: GZ8MTXP02FYG5T.4.59.F04.1.454.CMB.2.raw
  modified_base (211)..(211): a, c, t, g, unknown or other
  modified_base (440)..(440): a, c, t, g, unknown or other
  modified_base (565)..(565): a, c, t, g, unknown or other
  modified_base (589)..(589): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtcgtcccaggacagacacgccggnactctaccttctcgtaggataattaaagttcgggacctaattaaacgtttcggtacctttccgttgggtactcgacgacaagaacgcccgaacggtaccctaccggttaccccctaaagttccgttaggttaccatttacccgtaataccgaaagtaccttaaacccgaaacgggcccggtaccgttacggaacggggtacttcccggtagaccggtactacgtttccncggttcgtaccttacctacgtttcgacggggaaacctacgacgacctactacgtacgacctaccgtaccggaacccggtacacgggtctacgttagcgtaggacgtatacgtacttatttacggngtacgacggggtacgtcggaacgngacgacgtaccgtaaggttggggaacggtttcggggtaccggggacgggtaaacggggaaaaccctcgggtacccgttaaacggccccgtttaacggaaccgtacccgaacggtaccccgacggtaccccgtacccgggtaccccccgtttacgg

SEQ ID NO: 404051 - DNA, 625 bp, Homo sapiens
  misc_feature: GZ8MTXP02GLHYZ.4.59.F04.1.454.CMB.2.raw
  modified_base (316)..(316): a, c, t, g, unknown or other
  modified_base (360)..(360): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtgtttctcgtggagctggatccggcacgccccgagggaggctggagtgatggcatatctcttacagtggancgaccaactaccaaccctccacgaagacgtcgtgtactaccgtntacaatacgaccaacgtaccaaacgaacctagtttacctacccgtagacgtctcgaacgtctacgtcggcgaacccgcggacggacgaccggtccgtagttattccgtgtcgacgtagtactttccgtttaggttagtttttagggacgttaccggttaaccccgttggacttacgggttccgggaccgtacggggtaaccccttggtacccgtaccgtctaaccgttcgacgttcccgaccgaccggaaccggtccctaaccgg

SEQ ID NO: 404052 - DNA, 576 bp, Homo sapiens
  misc_feature: GZ8MTXP02HXNLB.4.59.F04.1.454.CMB.2.raw
  modified_base (317)..(317): a, c, t, g, unknown or other
  modified_base (340)..(340): a, c, t, g, unknown or other
  modified_base (458)..(458): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagcctttcggagaccctgtccctcacctgcactgctctggtgactcaataagtagtttctctgagctggatcggcagccccagggaaggactggagtggattggcatatctcttacagtgggancacaactacaacccttccacaancgtctcgtcaccgtgtacaatgacacgtccaaaagaaccagttctacccgtgaaggctagagctcgtgagacccgccgacggacacggccgttagttatttcgtgttcgccgaagttnttcgttacgttagtttcgtacgttaccgtacccgttggtccgtacggtacgggaccgaacgggtaaccctcggtacctaccgtctcgtacacgtcctaccgaaccgaacggccctacg

SEQ ID NO: 404053 - DNA, 751 bp, Homo sapiens
  misc_feature: GZ8MTXP02FG81F.4.59.F04.1.454.CMB.2.raw
  modified_base (219)..(219): a, c, t, g, unknown or other
  modified_base (224)..(224): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcactcaccttcnctganataattggccataattgcttcctggtatcagcagaagccaggccacgtcccctatactgtcatctatcgaaagataaccgaagccggcccctacgaggggactccccgtagaccggccgtattcgtccgtcggccttaccctagttccgtaggggaaccacgacgacccactctacgaaccctacgtcccggaacccgggaccccgacgggtacccaggttaacgaacgttcgggaaacgggtccgttacgtaacccgtttaaagtttacccgtagggttaccgacgggggtaccggttacggggtaacgaccggaccgaacggaccgtaaccgtagggggtaaacgggggtttcgggtttaacccgggggtacgggggaaaccgggggttaaaccccgaaaacgggttccccgtaacccgggtaacccccgggtttaaccccgtaaccggttaccccggaaacccgggtacccccgaaaaccgggggttccctacccccgggtccccccccggtttaaccccgggg

SEQ ID NO: 404054 - DNA, 741 bp, Homo sapiens
  misc_feature: GZ8MTXP02G1XZF.4.59.F04.1.454.CMB.2.raw
  modified_base (441)..(441): a, c, t, g, unknown or other
  modified_base (609)..(609): a, c, t, g, unknown or other
tcagagcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatggaggtgactcacgcccaccctcagtcgtccgtcgtccccgaggacagacacggccggctactccacctgctcgtaggaagtaattaaacgttcgggactaattaaatttcgactacttccgtaggtactcagaccgaagaacgaccccgagggccccaaccggttaccccctagtaccgttggtaccattactatacgaaaagtaccgtaacccgaaacggtccccgggaccctacgggaagggtaccttccccccggtagaccgtacgttacgttcctacgnggtcccttaccgtaattccggtacgggaaccacccgacgtacccacgttacccacggaacccaacggttccccgaacccccggggtacacggggacttagggaccgagtacggaacgtcgtaactacgttaacgtaccgtgggtacgtaaccgggtggtacccggganacgacgtacggacgtaggtacgggtacgggtccgggtaccggggacgggtaaccggaccgtacggtcgtacccggtaacccggtcccgtacgacccgaaaccggtaccccgtaccggtcccgttacccccgg

SEQ ID NO: 404055 - DNA, 671 bp, Homo sapiens
  misc_feature: GZ8MTXP02IYDCY.4.59.F04.1.454.CMB.2.raw
  modified_base (250)..(250): a, c, t, g, unknown or other
tcagagcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtcctcacctgcactgtctctggtcactcataagtagtttnttctggagcgtggatcggcacgccccgagggaacggacgtaggagtggagttggcagttactctacttacgaggtgggagaccaacccaaactaccccaaaccccgttacccactaagaccgtcgtcgtacaccggttgtaccaataccgaacgacgtacccaaagtaaccctacgtttacccgtacccgtagacggtcctagaacgtccttcgtgtaccgaccgtccggaccgacgcggtccgttagttctttcgtggttcgacgtacgttaactttcgtttacgtagtttttaggacgtttaccggtaaccccgttggtaccgtcggtaccggggaccgtaaacgggtacccttacggtacccgtaccgttcgttaactccgaacggtccctaccgaacccggacggaccccgtttcgg

SEQ ID NO: 404056 - DNA, 700 bp, Homo sapiens
  misc_feature: GZ8MTXP02HOPYM.4.59.F04.1.454.CMB.2.raw
  modified_base (206)..(206): a, c, t, g, unknown or other
  modified_base (274)..(274): a, c, t, g, unknown or other
  modified_base (436)..(436): a, c, t, g, unknown or other
  modified_base (568)..(568): a, c, t, g, unknown or other
tcagagcactgtagcacgaccggtgctcgatttagtacacacacttaggggattggggctgggcctcaggaagcagcatcggaggtgcctcagccatggcatggatccctctcttcctcggcgtccttgcttactgcacaggctccgtggcctcctatgaggtgactcacgccaccctcagtcgtccgtcgtcccgaggacagacncggccggcactcctaccttctcgtaggagaataagttcgggacctaataactttcgtcttcgtggtancagcagacgccgaggccacgttccctagtccgttcgtacagtactataacgaacaacctaaccgaacggtcccggacccttacggaacggtaccctccgtaggacccgtacgtacttcgttccgtcggtccttacgtacgttcggaaggaaccacggtaccnccactacctaccgaactacccgtacccgggaacccggtcgtaagggtccttaggtaacggacgttacgggcgttaacgttacgtacgtttagttaaccgttcggtcggtaacggggtcgggcggacgacggngtaacggtccagggtttacggacggggttacgggtaccggggacggggtaaacgccggtacggaccgtccggtacccgtaccggtaaccgaccgacgggtacccctacggccccgtcccgtacccggtcccg

SEQ ID NO: 404057 - DNA, 494 bp, Homo sapiens
  misc_feature: GZ8MTXP01D032U.22.28.C06.1.454.CMB.2.raw
  modified_base (490)..(494): a, c, t, g, unknown or other
tcagacatacgcgtcacgaccggtgctcgatttagagctcacgtattgggtttgggccgtccctgggcccagtctgtgttgactcagccaccctcagcgtctgggaccccgggcagagggtcaccatctcttgttctggaagcgactccaacatcggcgatactcatgtgtactggtaccaacaggtcccagggaccgccccaaactcctcatgtatgacagtagtgagcggccctcaggggtccctgaccgattctctggctctaagtctggcacctcggcctccctggacatcagtggcctccggtccgaggatgaggctgattattactgtgcagcatggattacaactgagtgaatcctgttgggtgttcgggcggagggaccagggctgaccgtcctaggtcagcccaaggctgccccctcggtcactctcgttccccacccttcctcacgcgtatgtctgagcgggctggcaaggcgcattagnnnnn

SEQ ID NO: 404058 - DNA, 539 bp, Homo sapiens
  misc_feature: GZ8MTXP01DX0AB.22.28.C06.1.454.CMB.2.raw
  modified_base (205)..(205): a, c, t, g, unknown or other
  modified_base (265)..(265): a, c, t, g, unknown or other
  modified_base (495)..(495): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggnagagggtcaccatctcttgttctggaagcgactccaacatcggcgatactcatgtgtacnggtaccaacaggtcccagggaccgcccccaaactccctcatgtatgacagtagtgagccggccctgacgggggtccctgaccgatttcctcgtggctctaaagtctggcctacccgtcggccctcccgtggacatcagtggccctccggtccgaggatcgaggctgattattactgtgcagcagtggattacactgagtgatctggttgggtgttcgggcgggaggaccnggcgttggaccgtccgtaggtcacgcccgaggcttccgcccccg

SEQ ID NO: 404059 - DNA, 492 bp, Homo sapiens
  misc_feature: GZ8MTXP01CKOTA.22.28.C06.1.454.CMB.2.raw
  modified_base (487)..(492): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggacttacactgagtgaatcctgtgggtgttcgggcggagggaccaggctgaccgtctaggtcagcccaaggctgccccctcggtcactctcgttcccaccctcctcacgcgtatgtctgagcggctggcaaggcgcattgnnnnnn

SEQ ID NO: 404060 - DNA, 495 bp, Homo sapiens
  misc_feature: GZ8MTXP01EGDPN.22.28.C06.1.454.CMB.2.raw
  modified_base (491)..(491): a, c, t, g, unknown or other
  modified_base (493)..(495): a, c, t, g, unknown or other
tcagacatacgcgtcacgaccggtgctcgatttagagctcacgtattgggtttggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacgcccccaaactcctcatgtatgacagtagtgagcggccctcaggggtccctgaccgattctctggctctaagtctggcacctcggcctccctggacatcagtggcctcggtccgaggatgaggctgattattactgtgcagcatgggattaaaacctgagtgatcctagttggggtgttcgggcggagggaccagggctgaccgtctaggtcagcccaaggctcgccccctcggtcactctcgttccccaccctcctcacgcgtatgtctgagcgggctggcaaggcgcatagngnnn

SEQ ID NO: 404061 - DNA, 499 bp, Homo sapiens
  misc_feature: GZ8MTXP01DJO5Q.22.28.C06.1.454.CMB.2.raw
  modified_base (494)..(499): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggacttacactgagtgaatctgtgggtgttcgggcggagggaccaggctgaccgtctaggtcagcccaaggctcgccccctcggtcactctcgttcccacccctcctcacgcgtatgtctgacgcgggcgtggcgaaggcgcattagnnnnnn

SEQ ID NO: 404062 - DNA, 499 bp, Homo sapiens
  misc_feature: GZ8MTXP01DAVAJ.22.28.C06.1.454.CMB.2.raw
  modified_base (494)..(499): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacgcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattaaaacctgagtgatccctagttgggtgttcgggcggaggggaccagggctgaccgtctaggtcagcccaaggctgccccctcggtcacgtctgttccccaccctccctcacgcgtatgtctgagcgggctggcaaggcgcatagnnnnnn

SEQ ID NO: 404063 - DNA, 502 bp, Homo sapiens
  misc_feature: GZ8MTXP01DGAWA.22.28.C06.1.454.CMB.2.raw
  modified_base (471)..(471): a, c, t, g, unknown or other
  modified_base (496)..(502): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcagtgggacttacaactgagtgaatctgttgggtgttcgggcggagggcagggctgaccgtctaggtcagcccaaggctcgcccccgtcggtcactctcgttcccacccctcctccacgcgtatgtctgngcgggctgggcaaggcgcagttagnnnnnnn

SEQ ID NO: 404064 - DNA, 489 bp, Homo sapiens
  misc_feature: GZ8MTXP01DORWR.22.28.C06.1.454.CMB.2.raw
  modified_base (487)..(489): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaactgatgaatctgtgggtgttcgggcggagggacaggctgaccgtcaggtcagcccaaggctcgccccctcggcactctcgttccccaccctcctcacgcatatgtctgagcgggctggcaaggcgcagtagnnn

SEQ ID NO: 404065 - DNA, 507 bp, Homo sapiens
  misc_feature: GZ8MTXP01D9AFD.22.28.C06.1.454.CMB.2.raw
  modified_base (498)..(500): a, c, t, g, unknown or other
  modified_base (502)..(507): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgacccgattctctggctctaagtctggcactcggcctccctggcatcagtggcctccggtccgaggatgaggctgattatactgtgcagcatgggattacactgagtgaactcctaaggttgggtgttcgggcggagggaccaggctgaccgtctaggtcacgcccaaggctcgcccctggtccactctcgttcccggcccttctccacgtcgtatcgtcagtcgcgggctgggcaaggcgcattgnnngnnnnnn

SEQ ID NO: 404066 - DNA, 506 bp, Homo sapiens
  misc_feature: GZ8MTXP01DXVZB.22.28.C06.1.454.CMB.2.raw
  modified_base (503)..(506): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctgacggggtccctgaccgattctctggctctaagtctggcacctcggccctccctggacatcagtcggcctccggtccgaggatgaggctgatttatactgtgcagcagtgggacttacaactgagtgaatcctggttgggtgttcgggcggagggaccaggctgaccgtcctaggcacgcccaaggctcgccccctcggtccactctcgttccccaccctcctccacgcgtatgtctggagcgggctggcaaggcgcattagnnnn

SEQ ID NO: 404067 - DNA, 528 bp, Homo sapiens
  misc_feature: GZ8MTXP01CA8B0.22.28.C06.1.454.CMB.2.raw
  modified_base (513)..(513): a, c, t, g, unknown or other
  modified_base (515)..(516): a, c, t, g, unknown or other
  modified_base (518)..(528): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgacccgattctctggctctaagtctggcacctcggcctccctggacatcagtggcctcggtccgaggatgaggctgattattactgtgcagcatgggacttacactgagtgaatcctgttgggtgttcgggcggagggaccagggctgaccgtctaggtcagcccaaggcctcgcccccgtcggtcactctcgttccccggccctccctcaccgcgtagtcgtctcggaggccggggtctgggccaagggccgcgaagttggngnngnnnnnnnnnnn

SEQ ID NO: 404068 - DNA, 505 bp, Homo sapiens
  misc_feature: GZ8MTXP01CT504.22.28.C06.1.454.CMB.2.raw
  modified_base (454)..(454): a, c, t, g, unknown or other
  modified_base (495)..(505): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaactgatgaatcctgttgggtgttcgggcggagggacagggctgaccgtctaggtcagcccaaggctcgcccctcggtcactctcgttcccggccctcctcncgcgtatgtctgacgcgggctgggcgaaggcgcgagttagnnnnnnnnnnn

SEQ ID NO: 404069 - DNA, 488 bp, Homo sapiens
  misc_feature: GZ8MTXP01CL9YJ.22.28.C06.1.454.CMB.2.raw
  modified_base (441)..(441): a, c, t, g, unknown or other
  modified_base (457)..(457): a, c, t, g, unknown or other
  modified_base (465)..(465): a, c, t, g, unknown or other
  modified_base (481)..(481): a, c, t, g, unknown or other
  modified_base (486)..(488): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacactgagtgaatcctgtgggtgttcggcggaggaccaggctgaccgtctaggtcagcccaaggctgccccctggtcactctcgttccccnccctcctcacgccgtntcgtctgngcggctggcaaggcgnattgnnn

SEQ ID NO: 404070 - DNA, 505 bp, Homo sapiens
  misc_feature: GZ8MTXP01DRJPR.22.28.C06.1.454.CMB.2.raw
  modified_base (353)..(353): a, c, t, g, unknown or other
  modified_base (381)..(381): a, c, t, g, unknown or other
  modified_base (436)..(436): a, c, t, g, unknown or other
  modified_base (451)..(451): a, c, t, g, unknown or other
  modified_base (458)..(458): a, c, t, g, unknown or other
  modified_base (466)..(466): a, c, t, g, unknown or other
  modified_base (482)..(482): a, c, t, g, unknown or other
  modified_base (493)..(493): a, c, t, g, unknown or other
  modified_base (498)..(505): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctcgagggggtccctgaccgattctctggctctaagtctggcacctcggcctccctggaccatcagtcggcctccggtccgaggatgaggctgatttatactgtgcagcatgtnattacaactgagtgatcgtagttgggtnttcgggcgggaggcagctgaccgtcgtaggtcacgaccgaggctcgcccctgacnctctcgggttccccnccttccncgcgtctntgtctgcggtcggcgnggaacacgcgnagtannnnnnnn

SEQ ID NO: 404071 - DNA, 498 bp, Homo sapiens
  misc_feature: GZ8MTXP01BYL7S.22.28.C06.1.454.CMB.2.raw
  modified_base (493)..(498): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcagggggtccctgaccgattctctggctctaagtctggcacctcggcctccctggacatcagtggcctccggtccgaggatgaggctgattatactgtgcagcatggggattacaactgagtgaatcctgttgggtgttcggcggaggggaccagggctgaccgtcctaggtcagcccaaggctcgcccctcggcactctcgttcccggccctcctcacgcgtatgtctgagcgggctggcaaggcgcattagnnnnnn

SEQ ID NO: 404072 - DNA, 723 bp, Homo sapiens
  misc_feature: GZ8MTXP01EIOZL.22.28.C06.1.454.CMB.2.raw
  modified_base (346)..(346): a, c, t, g, unknown or other
  modified_base (412)..(412): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcacgtcccagggcagggactggaatggattggattattccagtacactgcgatgaccaaactcgacccaaacccctcctacgagggctcgagtcagcctgtcagtacgacacgtcaaagaaccagtaccttccngacacttcgaccccttctggtacgacccgccgacgaagaaccgtacgggccgttgttacttttcgngggttcgtacgggtacgtagtcggtaccagttcgaactacgtacaaacaaaacctaacgtcggtaccttaccggtcggggaccggaaacggggtaaccccgttcgggtaccctacccggttccctacccttccggaaccccgtccccgtaacccgaaacccggtaacccgggtccccgtaacccgtttccccggttccccgttcccccggttaccggtacccctaaccccgttaccccgttacccgaacggtaacccgtacccgtaacccggtcgggaccggggaccctaaccgggttccgggtccccggg

SEQ ID NO: 404073 - DNA, 542 bp, Homo sapiens
  misc_feature: GZ8MTXP01DX1FN.22.28.C06.1.454.CMB.2.raw
  modified_base (348)..(348): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtctgggaccccccgggcagagggtcaccatctcttgtctggaagcgactccaacatcggcgatactcatgtgtactggtaccaacacggtcccaggggaccggccccccaaactccctcatgtatgacagtagtgacgcggcctcgacggggtcccngaccgacttctctggctctaaagtctggccaccgtcggcctccctggacatcagtcggcctccggtccgaggactgagctgattattactgttgcagcagtgggacttacgaactgagtgactcgtggtggtgttcgggcggttaggaccgtggcgttgaccgtcgtggtcgcgcccaggtccgttcgtccccg

SEQ ID NO: 404074 - DNA, 537 bp, Homo sapiens
  misc_feature: GZ8MTXP01CLFX0.22.28.C06.1.454.CMB.2.raw
  modified_base (399)..(399): a, c, t, g, unknown or other
  modified_base (523)..(523): a, c, t, g, unknown or other
  modified_base (526)..(537): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctccctggacatcagtcggcctccggtccgagatgagctgattattactgtgcagcagtgggaacttacaactgagtgaactctggttgggtgttcgggcgggagggaccgnggctgaccgtccgtaggtcacgcccgaaggcctccgcccccgtcggtccacctcgttccgttccccggccccttcctccaccgtcgtatcgtcgtggacggtcgggctgggcgaaggcgacganagnnnnnnnnnnnn

SEQ ID NO: 404075 - DNA, 747 bp, Homo sapiens
  misc_feature: GZ8MTXP01B999Z.22.28.C06.1.454.CMB.2.raw
  modified_base (208)..(208): a, c, t, g, unknown or other
  modified_base (234)..(234): a, c, t, g, unknown or other
  modified_base (245)..(245): a, c, t, g, unknown or other
  modified_base (255)..(255): a, c, t, g, unknown or other
  modified_base (428)..(428): a, c, t, g, unknown or other
tcagacatacgcgtcacgaccggtgctcgatttagagctcacgtattgggtttggggagcttcagctgtggtagagaagacaggattcaggacaatctccagcatggcaggcttccctctcctcctcaccctcctcactcactgtgcagggtcctgggcccagtctgtgttgactcacgccaccctcagcgtcgtcgggacccccggnagaggtcacatctcttgtctggaacncgactccaacngtcggcatcncatgtgtactggtaaccaacgacggtcccgagggaccccgacccccaaactcctacatgtactgaactagtagtgaggccggccctggacggggtccctggtaacccccgtattcgtcgtggtccttaacgtaacgttcgacgggtcctacccgtccgggcccctttacccgngggaacctacgttccgaacgggttccgggccccgttcccgggttaccggaacgggtacgtggaacgggtaccttaggtactttaagttaccgttgggttcgtacgagtcgtaaggttcgggaacttacccgtaaacgtcggtaagttacgtaaacgtttcccggttaaggggttttcgggggttacgggtttcccgggggcggggtaaacccgggggaaccgttacggggttccgttacccgggttaaccccggttacccgggttaacggttcccgaccggttaaccccggtaacgggttccccgtttaaccccccggg

SEQ ID NO: 404076 - DNA, 505 bp, Homo sapiens
  misc_feature: GZ8MTXP01BJCT6.22.28.C06.1.454.CMB.2.raw
  modified_base (502)..(505): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcagggggtccctgaccgattctctggctctaagtctggcacctcggcctccctggacatcagtggcctccggtccgaggatggaggctgattattactgtgcagcagtgggacttacaactgagtgaatcctggttgggtgttcgggcggtagggacagggctgaccgtccgtaggtcacgcccaaggctcgcccctcggcactctcgttccccaccctcctcacgcgtatgtctgcgtcgggctcgggcaaggcgcattgnnnn

SEQ ID NO: 404077 - DNA, 513 bp, Homo sapiens
  misc_feature: GZ8MTXP01A8BM7.22.28.C06.1.454.CMB.2.raw
  modified_base (506)..(513): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaactgagtgaatcctgttgggtgttcgggcggaggggaccagggctgaccgtccgtaggtcagcccaagggcctcgccccctcggtcactctcgttccccggccctcctccacgtcgtatgtcctgacggcgggctgggcaaggcgcattagnnnnnnnn

SEQ ID NO: 404078 - DNA, 593 bp, Homo sapiens
  misc_feature: GZ8MTXP01AVGBI.22.28.C06.1.454.CMB.2.raw
  modified_base (205)..(205): a, c, t, g, unknown or other
  modified_base (260)..(260): a, c, t, g, unknown or other
  modified_base (264)..(264): a, c, t, g, unknown or other
  modified_base (350)..(350): a, c, t, g, unknown or other
  modified_base (454)..(454): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggnagagggtcaccatctcttgttctggaagcgactccaacatcggcatactcatgtntacnggtaccaagacggtcccagggaccgccccccaaatcctcatgtatgacagtagtgaggccggccctgacggggtccctgacccgtnttctcgtggcctctaaaagtctcggcctacccgtcgggccctcccgtggacactcagtcggccttccggtccgaggatgaggtctagactttattactggtcgnagtcagtgggtaattacaaccgtgagtgacttccgtagggttgggtcggttcggggacggaggggtacccagggttccgttcggaccccggttcgtacgggtccacggaccccgaacgggtccgttcccgtccccccgg

SEQ ID NO: 404079 - DNA, 504 bp, Homo sapiens
  misc_feature: GZ8MTXP01C3HJF.22.28.C06.1.454.CMB.2.raw
  modified_base (497)..(504): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaactgagtgaatcctaagttgggtgttcgggcggagggaccaggctgaccgtcctaggtcagcccgaaggctcgccccctcggtcactctcgttcccaccctcctcacgcgtactgtctgacgcgggctgggcaaggcgcattagnnnnnnnn

SEQ ID NO: 404080 - DNA, 501 bp, Homo sapiens
  misc_feature: GZ8MTXP01CDAZ9.22.28.C06.1.454.CMB.2.raw
  modified_base (457)..(457): a, c, t, g, unknown or other
  modified_base (462)..(462): a, c, t, g, unknown or other
  modified_base (486)..(486): a, c, t, g, unknown or other
  modified_base (492)..(501): a, c, t, g, unknown or other
tcagacatacgcgtcacgaccggtgctcgatttagagctcacgtattgggtttgggggtcgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgatttattactgtgcagcagtggacttacactgatgaatcgtgttgggtgttcgggcggagggaccagggctgaccgtcgtaggtcagcccaaggcctcgccccctggcactctcgttcccggccctcctcncgctntgtcgtgcgcgggctggcaaggcncattgnnnnnnnnnn

SEQ ID NO: 404081 - DNA, 588 bp, Homo sapiens
  misc_feature: GZ8MTXP01BA31X.22.28.C06.1.454.CMB.2.raw
  modified_base (356)..(356): a, c, t, g, unknown or other
  modified_base (397)..(397): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgccaacccctcctcaggctcgagtcagcctgtcagtagacacgtaccaaagaacccagaccttcccagacgactgaccccctntgtcgacccgcgacaacgcgaccgggccgttgtattttcgngttggtcggtacgtagtcgtcatgacagtcaacaaacactgtctcgtggggccgaggacccgtggcaccgtctccgtcacgcctccaccgaacgggtcccaacgttccggttccttcccccgttggcccctaaccccttccttccaacgaacgcctaacccgttcggcgggggaccaacgaacggcccggg

SEQ ID NO: 404082 - DNA, 508 bp, Homo sapiens
  misc_feature: GZ8MTXP01CP8RB.22.28.C06.1.454.CMB.2.raw
  modified_base (500)..(508): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctcgaggggtccctgaccgattctctggctctaagtctggcacctcggcctccctggacatcagtggcctccggtccgaggatgaggctgattattactgtgcagcatggggacttacaactgagtgaatcctgttgggtgttcgggcggtagggaccagggctgaccgtccgtaggtcacgcccaaggctcgcccctcggtcactctcgttccccgccctcctccacgctatgtctgcgcgggctggcaagggcgcagttgnnnnnnnnn

SEQ ID NO: 404083 - DNA, 577 bp, Homo sapiens
  misc_feature: GZ8MTXP01AZ7MI.22.28.C06.1.454.CMB.2.raw
  modified_base (206)..(206): a, c, t, g, unknown or other
  modified_base (515)..(515): a, c, t, g, unknown or other
  modified_base (523)..(523): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggaccccccggnagagggtcaccatctcttgttctggaagcgactccaacatcggcgatactcatgtgtactggtaccaacacggtcccagggaccggcccccaaactcctcatgtatgacagtagtgagccggccctcgacgggggtccctgaccgtattcctcgtggcctcgtaaagtctgggccacccgtccgggccctcccgtggaccatcgagtcggcccgtccgggtccgaggtacgtggacggtctagatttaattactggtggcagcagtggatacgactgagtgattccgtaggttgggtggttcgggcggngggaccgnggccgttcggaccggtccgtaggtcacggcccgaacggtccgttccgtcccccg

SEQ ID NO: 404084 - DNA, 534 bp, Homo sapiens
  misc_feature: GZ8MTXP01CL6Y4.22.28.C06.1.454.CMB.2.raw
  modified_base (206)..(206): a, c, t, g, unknown or other
  modified_base (266)..(266): a, c, t, g, unknown or other
  modified_base (487)..(487): a, c, t, g, unknown or other
  modified_base (494)..(494): a, c, t, g, unknown or other
  modified_base (513)..(513): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggaccccccggnagagggtcaccatctcttgttctggaagcgactccaacatcggcgatactcatgtgtacnggtaccaacgaggtccccagggaccggccccccaaactccctcatgtatgacagtagtgagcggccctgacgggggtccctgaccgattctctggctctaaagtctggcacccgtcggccctccctggacatccagtcggccctccggtccgaggatggagctgattatactgtgcagcagtggattacactgagtgatcctagttgggtgttcgggcggnggaccgngcgttcgaccgtcgtgtcncgccgacgtccgttccgcccg

SEQ ID NO: 404085 - DNA, 509 bp, Homo sapiens
  misc_feature: GZ8MTXP01A0N5C.22.28.C06.1.454.CMB.2.raw
  modified_base (465)..(465): a, c, t, g, unknown or other
  modified_base (496)..(496): a, c, t, g, unknown or other
  modified_base (498)..(509): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggccctccggtccgaggatgaggctgattatactgtgcagcagtggacttacactgagtgaatccgtgttggggtgttcgggcgggagggaccaggctgaccgtcgtaggtcagccaaaggctcgccccgtcggcactctcgttcccgccctcctcacgcgtntgtctgcgcgggctcgggcaagggcgcgagngnnnnnnnnnnnn

SEQ ID NO: 404086 - DNA, 510 bp, Homo sapiens
  misc_feature: GZ8MTXP01AGIVK.22.28.C06.1.454.CMB.2.raw
  modified_base (476)..(476): a, c, t, g, unknown or other
  modified_base (493)..(493): a, c, t, g, unknown or other
  modified_base (500)..(510): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccgcccccaaactcctcatgtatgacagtagtgagcggccctcaggggtccctgaccgattctctggctctaagtctggcacctcggccctccctggacatcagtggcctccggtccgaggatgaggctgattattactgtgcagcatgggacttacactgagtgaatcctgtgggtgttcggcggtagggcagggctgaccgtcctaggtcagcccgaaggcctcgcccccgtggtccactcctcgttccccgccctccctcaccgcgtatgtctgngcgggctggcaagggcncgattgnnnnnnnnnnn

SEQ ID NO: 404087 - DNA, 632 bp, Homo sapiens
  misc_feature: GZ8MTXP01CA447.22.28.C06.1.454.CMB.2.raw
  modified_base (207)..(207): a, c, t, g, unknown or other
  modified_base (267)..(267): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtcgtcgggacccccggnagagggtcaccatctcttgttctggaagcgactccaacatcggcgatactcatgtgtacnggtaccaacgaggtcccaggggacccgacccccaaactcctcatgtatgacagtagtgagccggccctcgacggggtccctgaccgtacttcctcgtggcttcgtaaagtcctggcccacccgtccgggccctccccgtgggaccacgtccgaggtccgggtccccgtcccggggtacccggagggtacgttcgggaagggtcctaggtactttattacgtgttggcaagctaggtgggtacttaccgaccgtgaagtgtacgtccgttagggttgggtgggtttcgggcgggttagggacccgtaggccgttcggacccggttccgtacggtccgacgcccgaaggtcccgttccggtcccccg

SEQ ID NO: 404088 - DNA, 581 bp, Homo sapiens
  misc_feature: GZ8MTXP01A9KWK.22.28.C06.1.454.CMB.2.raw
  modified_base (456)..(456): a, c, t, g, unknown or other
  modified_base (553)..(553): a, c, t, g, unknown or other
  modified_base (569)..(571): a, c, t, g, unknown or other
  modified_base (573)..(581): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggaccgccccccaaatcctcatgtatgacagtagtgagcgccctgaggggtccctgaccgtattctctggcttactaagtctggccacctcggcctccctggacatcagtcggcctccggtccgaggatggaggctgattattactgtgcagcatgtgacttacgaacctgagtacgattccgtagggtttcgggtgttcggggacgggacggggacaggtcgacgtaccgtcgtacggtccacggacccgaacggtccncccggtcccccgtcggtacctccttccgtttcccggggttcccccgtaccctttccgaccgtaccggtcgtattcgtacgtcggtcgggcggttcgnggcgaacgcgattagnnngnnnnnnnnn

SEQ ID NO: 404089 - DNA, 546 bp, Homo sapiens
  misc_feature: GZ8MTXP01D7US6.22.28.C06.1.454.CMB.2.raw
  modified_base (210)..(210): a, c, t, g, unknown or other
  modified_base (350)..(350): a, c, t, g, unknown or other
  modified_base (464)..(464): a, c, t, g, unknown or other
  modified_base (495)..(495): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggaccccccgggnagagggtcaccatctcttgttctggaagcgactccaacatcggcatactcatgtgtactggtaaccaacacggtcccaggggaccggaccccccaaaactccctcatgtatgacagtagtgagccggcctgacgggtccngaccgattctcgtggctctaaagtctggcaccgtcggccctccgtggacatcagtcggccgtcggtccgagatgaggtctgattattactgtgcagcagtggatacactgagtntatcgtggtgggtgttcgggcgggaggacgnggcgttcgaccgttcgtaggtcacggtcccgaaggtccttccggtcccccg

SEQ ID NO: 404090 - DNA, 502 bp, Homo sapiens
  misc_feature: GZ8MTXP01A4R05.22.28.C06.1.454.CMB.2.raw
  modified_base (439)..(439): a, c, t, g, unknown or other
  modified_base (465)..(465): a, c, t, g, unknown or other
  modified_base (471)..(471): a, c, t, g, unknown or other
  modified_base (473)..(473): a, c, t, g, unknown or other
  modified_base (489)..(489): a, c, t, g, unknown or other
  modified_base (492)..(492): a, c, t, g, unknown or other
  modified_base (494)..(502): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctccctggacatcagtggcctcggtccgaggatgaggctgattattactgtgcagcagtgggacttacaacgtgagtgaatcctggttgggtgttcgggcgggtagggaccagggctgaccgtctaggtcacgccaaggctcgcccctcggcnctctcgtcccgccctcctccacgctncgtcgngngcgggctggcaaggcncangnnnnnnnnn

SEQ ID NO: 404091 - DNA, 715 bp, Homo sapiens
  misc_feature: GZ8MTXP01D2K49.22.28.C06.1.454.CMB.2.raw
  modified_base (270)..(270): a, c, t, g, unknown or other
  modified_base (366)..(366): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggaccccccgggcaggagggtcaccatctcttgttctggaagcgactccaacatcggcatactcatgtgtacnggtaaccaacgacggtcccgaaggggacccgaccccccaaaactccctcatgtatgaacagtagtgagccggccctcgacggggtccctgaccgtnttctctggctactaaacgtctggccacccgtccgggcccctcccgtgggacatcaggtcggcccgtccgggtaccggaggtacgtggacggtctagtaacttatttaccgtggttcgacgtaaggtcctaaggttacggggtaactttaaacccgaaacgttacgggaagttcggtaaacgtttcccggtttaaggggtttgggggtttcgggtttccggggggacgggttaaacgggggaaccccggtagggggacccgttcgggttaaaccccggttcccggttaaaggggttccccgaaacgggtacccccggaaacgggtccccgtttcccgggtccccccccgg

SEQ ID NO: 404092 - DNA, 579 bp, Homo sapiens
  misc_feature: GZ8MTXP01BTYEZ.22.28.C06.1.454.CMB.2.raw
  modified_base (563)..(563): a, c, t, g, unknown or other
  modified_base (565)..(567): a, c, t, g, unknown or other
  modified_base (569)..(579): a, c, t, g, unknown or other
tcagacatacgcgtcacgaccggtgctcgatttagagctcacgtattggggtttgggggccgtccctgggcccagtctgtgttgactcagccaccctcagcgtctcgggacccccgggcagagggtcaccatctcttgttctggaagcgactccaacatcggcgatactcatgtgtactggtaccaacaggtcccaggggaccggcccccaaactcctcatgtatgacagtagtgagccggccctcgacgggggtccctgaccgtattctctggctctaagtcgtggccacccgtcggccctcccgtggacatcaggtcggccctccggtccgaggactggaggctagtatttattactgtgcagcagtggacttacactgagtgaatccgtggttgggtgttcgggcgggtacgggacgagggctcggaccgtccgtaggtcacgacccgaacggccgtccgcccccgtcgggtcctacctccgttcccttaccccgtacccctccctccaccgtcgtacgtccgtcgtcggcggcgggtcgtgggcgaacgggccgcaagngnnngnnnnnnnnnnn

SEQ ID NO: 404093 - DNA, 505 bp, Homo sapiens
  misc_feature: GZ8MTXP01DPQTW.22.28.C06.1.454.CMB.2.raw
  modified_base (438)..(438): a, c, t, g, unknown or other
  modified_base (481)..(481): a, c, t, g, unknown or other
  modified_base (499)..(505): a, c, t, g, unknown or other
tcagacatacgcgtcacgaccggtgctcgatttagagctcacgtattgggtttgggggccgtccctgggcccagtttgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctgaggggtccctgaccgattctctggctctaagtctggcacctcggcctccctggacatcagtggcctccggtccgaggatgaggctgattattactgtgcagcatgggattaccactgagtgatcctagttggggtgttcgggcgggagggaccagggctgaccgtctaggtcagcccaaggcctcgcccctcggtcnctctcgttccccgccgtcctcacgcgtatcgtctgaggcgggntgggcaaggcgcagtggnnnnnnn

SEQ ID NO: 404094 - DNA, 523 bp, Homo sapiens
  misc_feature: GZ8MTXP01EYTUT.22.28.C06.1.454.CMB.2.raw
  modified_base (513)..(523): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagcggccctcgaggggtccctgaccgattctctggctctaagtctggcacctcggcctccctggacatcagtggcctccggtccgaggatgaggctgattattactgtgcagcagtgggacttacactgagtgaatcctaaggttgggtgttcgggcgggtaggggaccagggctgacccgtcgtaggtcacgcccgaaggcctcgccccctcggtccactctcgttccccaccctcctcacgcgtatgtctgaggcgggctgggcgaaggcgcgattgnnnnnnnnnnn

SEQ ID NO: 404095 - DNA, 511 bp, Homo sapiens
  misc_feature: GZ8MTXP01ECP9K.22.28.C06.1.454.CMB.2.raw
  modified_base (462)..(462): a, c, t, g, unknown or other
  modified_base (471)..(471): a, c, t, g, unknown or other
  modified_base (504)..(511): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgagggggtccctgaccgattctctggctctaagtctggcacctcggcctccctggacatcagtcggcctccggtccgaggatgaggctgatttatactgtgcagcagtgggattacaactgagtgaattctggttgggtgttcgggcgaggggaccaggctgaccgtctagggtcaggcccgaaggctcgcccctcggtcactctcgtccccggccctccncacgctagngtctggtcgcgggctcggcgaaggcgcaattgnnnnnnnn

SEQ ID NO: 404096 - DNA, 627 bp, Homo sapiens
  misc_feature: GZ8MTXP01A7NSS.22.28.C06.1.454.CMB.2.raw
  modified_base (265)..(265): a, c, t, g, unknown or other
  modified_base (346)..(346): a, c, t, g, unknown or other
  modified_base (353)..(353): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggaccccccggagagggtcaccatctcttgttctggaagcgactccaacatcggcatactcatgtgtacnggtaccaacacggtcccagggacccgaccccccaaactccctacatgtatgaacagtagtgagccggcctgacgggtcccngaccgtnttctcgtggctctaaagtctggcctacccgtcggcccctccgtggactactcagtcggcccgtccgggtccgaggtactggaggtcgtagtatttagttacgttgtcggacgtagcgtaggtacgggtaacttaaccgaaccgttaggtacggttgtaacgttccggttaagggtttcggggttaggttccggggacgggacgggaccgtaaggttccgttcggttacccgtcgtacggtccacggacccgacggtccgttaacccgtcccccg

SEQ ID NO: 404097 - DNA, 555 bp, Homo sapiens
  misc_feature: GZ8MTXP01DNQWL.22.28.C06.1.454.CMB.2.raw
  modified_base (207)..(207): a, c, t, g, unknown or other
  modified_base (358)..(358): a, c, t, g, unknown or other
  modified_base (502)..(502): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggaccccccgggnagagggtcaccatctcttgttctggaagcgactccaaacatcggcgatactcatgtgtactggtaaccaacgaggtcccagggacccgcccccaaactcctacatgtatgacagtagtgagccggcctcgacgggtcctgaccgtattctntggctcgtaaagtctggcctacccgtccgggccctccccgtaggacactcgagtcggccctccggtccgaggatggaggtctgtattattacgtgtggcagcagtcggattaccgaactgagtgatccgtggtgggtgttcggnggaggcaggcgttgttacccgtgtagtccgagcccaggtccgttcgtcccccg

SEQ ID NO: 404098 - DNA, 716 bp, Homo sapiens
  misc_feature: GZ8MTXP01DX5FT.22.28.C06.1.454.CMB.2.raw
  modified_base (186)..(186): a, c, t, g, unknown or other
  modified_base (207)..(207): a, c, t, g, unknown or other
  modified_base (219)..(219): a, c, t, g, unknown or other
  modified_base (223)..(223): a, c, t, g, unknown or other
  modified_base (233)..(233): a, c, t, g, unknown or other
  modified_base (242)..(242): a, c, t, g, unknown or other
  modified_base (247)..(247): a, c, t, g, unknown or other
  modified_base (252)..(252): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctnagcgtcgtgggacccccgggnaggacggtcacntctnttgtcgagancactacaangtcgnatacnatgtagtacacgtaaccaacgacggtaccgaacgggacccgaccccaaactcctactatagtatacgacgtaaggtagtcgacggccggtcccgtacggtacgggtccctacggtaccgtacttctcgtcgtacctacgtaaacgtcgtcggaccctacccgtcccggtcccctcccgtacggaactacgtcgtacggtccggtcccgtccgggtaccggaggtagtacggtacggtactagttaactttaacgttacgtggtacgggacgtaacgtacgtaacggtaacggtaacgttaaaccgtaaacgtaacgtacggtacgtacgttaccggttacgggtttggggttcggggttacggggtacggggacgggaaccggtacgggttacggttccggttacccggtaaccggtacggtaaccggaccggacccggaccggtaacccgttccccgtccccg

SEQ ID NO: 404099 - DNA, 529 bp, Homo sapiens
  misc_feature: GZ8MTXP01ESJEF.22.28.C06.1.454.CMB.2.raw
  modified_base (508)..(508): a, c, t, g, unknown or other
  modified_base (514)..(514): a, c, t, g, unknown or other
  modified_base (516)..(529): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctcgaggggtcccctgaccgattctctggcttctaagtctggcaccctcggccctccctggacatcagtggcctccggtccgaggatggaggctgattatactgtgcagcagtggacttacactgagtgaatccgtaaggttgggtgttcgggcgggagggaccagggctcgaccgtccgtaggtcacgcccaaggctcgcccctcggccactctcgtcccgccctcctcacgcgtatcgtctggacggcgggcgtcgggcgaagggcncgaagngnnnnnnnnnnnnnn

SEQ ID NO: 404100 - DNA, 544 bp, Homo sapiens
  misc_feature: GZ8MTXP01CGTWC.22.28.C06.1.454.CMB.2.raw
  modified_base (535)..(544): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggcctctagtctggcacctcggccctccctggacatcagtcggcctccggtccgaggatgaggctgatttattactgtgcagcagtggacttacactgagtgaatccgtggttgggtggttcgggcggagggaccgagggctcgaccgtcgtagtcgacgcccgaaggtcctccgcccccgtcggtcctacttccgttccgttccccacccttccctccaccgcgttatcgtcgtggcggtccgggcgtcgggccgaagggcgcgattagnnnnnnnnnn

SEQ ID NO: 404101 - DNA, 552 bp, Homo sapiens
  misc_feature: GZ8MTXP01EDEFO.22.28.C06.1.454.CMB.2.raw
  modified_base (208)..(208): a, c, t, g, unknown or other
  modified_base (236)..(236): a, c, t, g, unknown or other
  modified_base (438)..(438): a, c, t, g, unknown or other
  modified_base (460)..(460): a, c, t, g, unknown or other
  modified_base (500)..(500): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtgggaccccccggnagagggtcaccatctcttgttctggaancgactccaacatcggcgatactcatgtgtactggtaccaacgacggtcccagggaccggccccccaaactccctcatgtatgacagtagtgagcggcctgacgggtcctgaccgtacttctctggctctaaagtctggcaccgtcggcctcctggacatcagtcggccgtccggcgaggactgagctgattatactgtggcngcagtggacttacacgtgagtnacgttcgtagggttgggtgttcggggcggttagggaccgngggttcgttcggaccgtccgtaggtcgacgcccgaggtccgccggtcccccg

SEQ ID NO: 404102 - DNA, 516 bp, Homo sapiens
  misc_feature: GZ8MTXP01EO2MA.22.28.C06.1.454.CMB.2.raw
  modified_base (505)..(516): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagcggccctcaggggtccctgaccgattctctggctctaagtctggcacctcggcctccctggacatcagtggcctcggtccgaggatggaggctgatttattactgtgcagcagtggattacactgagtgaatctgttgggtgttcgggcggagggaccagggctgaccgtcctaggtcacgcccgaaggctcgcccccgtcggccactctcgttccccaccctcctccacgcgtagtcgtctgacgtcgggctgggccaaggcgcagttgnnnnnnnnnnnn

SEQ ID NO: 404103 - DNA, 537 bp, Homo sapiens
  misc_feature: GZ8MTXP01CFKIG.22.28.C06.1.454.CMB.2.raw
  modified_base (473)..(473): a, c, t, g, unknown or other
  modified_base (527)..(537): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggacgcccccaaactcctcatgtatgacagtagtgagcggccctcgaggggtccctgaccgattctctggctctaagtctggcacctcggcctccctggacatcagtggcctccggtccgaggatggaggcttgattattactgtgcagcagtgggacttacaacgtgaacgtgaacttcctaaggttgggtggttcgggcgggaggggacccgagggctgaccgtcgtacggtcacgcccgaaaggctcgcccctcggtccactctcgttaccccnccctcctccacgtcgtatcgtctcgacgtcggggctggcgaacggcgcattagnnnnnnnnnnn

SEQ ID NO: 404104 - DNA, 576 bp, Homo sapiens
  misc_feature: GZ8MTXP01B0TA2.22.28.C06.1.454.CMB.2.raw
  modified_base (207)..(207): a, c, t, g, unknown or other
  modified_base (534)..(534): a, c, t, g, unknown or other
  modified_base (550)..(550): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtctcgggacccccggnagagggtcaccatctcttgttctggaagcgactccaacatcggcgatactcatgtgtactggtaaccaacacggtcccaagggacccggaccccccaaactcctacatcgtatgacagtagtgacgcggccctcgacggggtcccctgaccgtacttcctcgtggtcctcgtaaagtcgtcggcctacccgtccgggccccttcccgtggactactcgtagtcggccctccgggtccgaggactggacgctagattattacgtgtgcagcagtggattacaacgttgagtgactccgtaggttgggtgttcgggcgggacgggacgnggcgttcgaccgtcgnggtcacgccgaggtccttcgtccccg

SEQ ID NO: 404105 - DNA, 513 bp, Homo sapiens
  misc_feature: GZ8MTXP01BG918.22.28.C06.1.454.CMB.2.raw
  modified_base (496)..(496): a, c, t, g, unknown or other
  modified_base (504)..(513): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagcggccctcgaggggtcccctgaccgattctctggctctaagtctggcacctcggccctccctggacatcagtggccctccggtccgaggatggaggctgatttattactgtgcagcatggattacactgagtgaatctggttgggtgttcgggcgggagggaccaggctgaccgtcgtaggtcagcccaaggctcgcccctcgtcactctccgtcccaccctcctcacgcgtatcgtctgcgcgggtcgtgggcgaagggcncgattagnnnnnnnnnn

SEQ ID NO: 404106 - DNA, 640 bp, Homo sapiens
  misc_feature: GZ8MTXP01DF985.22.28.C06.1.454.CMB.2.raw
  modified_base (625)..(625): a, c, t, g, unknown or other
  modified_base (627)..(628): a, c, t, g, unknown or other
  modified_base (630)..(640): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggacggcccccaaactcctcatgtatgacagtagtgagcggccctcgaggggtccctgaccgattctctggctctaagtctggcacctcggcctccctggacatcagtcggcctccggtccgaggatggaggctagattattactgtgcagcagtgggacttacgaactggagtggaattccgttaaggttggggtcgttcggggacgggacggggtaccaggggcctacggtacccgtccgtacgggtcaacggcccgaaacgggtccctccggtcccccccgttcgggtccctacccgtttcccgttccccggtttcccccgggtccccctttccccgtacccgtaacccggttccgttacgtcgggttacgttgggacgggccgggggtacgttcggggaccgaaacggggcccgacgagttaggngnngnnnnnnnnnnn

SEQ ID NO: 404107 - DNA, 557 bp, Homo sapiens
  misc_feature: GZ8MTXP01EOAUW.22.28.C06.1.454.CMB.2.raw
  modified_base (207)..(207): a, c, t, g, unknown or other
  modified_base (266)..(266): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtctgggaccccccggnagagggtcaccatctcttgtctggaagcgactccaacatcggcgatactcatgtgtacnggtaccaacaggtcccagggaccgcccccaaatcctcatgtatgacagtagtgagcggccctgagggggtcccctgaccgtattctcgtggctcgtaaaagtctggccacccgtcggtccctacccgttgggacagtcagtcggcccgtccggtccgaggagtgaggctgtattattacgtgtggctagcagtggacttacaactgagtgtagtcctaggtgggtgttcgggcggttagggccgaggcgttcgacccgtctaggtcacgcccgaggtccgttcgtcccccg

SEQ ID NO: 404108 - DNA, 579 bp, Homo sapiens
  misc_feature: GZ8MTXP01AJF9J.22.28.C06.1.454.CMB.2.raw
  modified_base (206)..(206): a, c, t, g, unknown or other
  modified_base (570)..(570): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccggnagagggtcaccatctcttgttctggaagcgactccaacatcggcgatactcatgtgtactggtaccaacgacggtcccgaggggaccggaccccccaaactccctcatcgtatgacagtagtgagcggcctcgacgggggtccctgaccgtacttctgtggctctaaacgtcgtggcctacccgtccggcccctcccgtgggactactccgtaggtcgggccccgttcccgggtcccggagggagttcggaggtctagtacttattactgtggcagcagtggtatacgactgagtgtactccgtaggttgggtgttcgggcggagggccgaggcgttcgaccgtcgtagtcgacgccgaggtcnccgtccccg

SEQ ID NO: 404109 - DNA, 483 bp, Homo sapiens
  misc_feature: GZ8MTXP01DOA5T.22.28.C06.1.454.CMB.2.raw
  modified_base (444)..(444): a, c, t, g, unknown or other
  modified_base (457)..(457): a, c, t, g, unknown or other
  modified_base (474)..(474): a, c, t, g, unknown or other
  modified_base (476)..(476): a, c, t, g, unknown or other
  modified_base (478)..(483): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacgcccccaaactcctcatgtatgacagtagtgagcggccctcaggggtccctgaccgattctctggctctaagtctggcacctcggcctccctggacatcagtggcctccggtccgaggatgaggctgattatactgtgcagcatggattacaactgagtgaatctgttgggtgttcggcggagggcaggctgacgtcaggtcagcccaaggctcgcccctcggtcactctcgttcccaccctctcncgcgtatgtctgngcggctggcaaggcganangnnnnnn

SEQ ID NO: 404110 - DNA, 513 bp, Homo sapiens
  misc_feature: GZ8MTXP01DNDLT.22.28.C06.1.454.CMB.2.raw
  modified_base (506)..(506): a, c, t, g, unknown or other
  modified_base (508)..(513): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggaccggcccccaaactcctcatgtatgacagtagtgagcggccctcgaggggtccctgaccgattctctggctctaagtctggcacctcggcctccctggacatcagtggcctccggtccgaggatgaggctgattattactgtgcagcatgggacttacaactgagtgaatctggttgggtgttcgggcgggagggaccagggctgacccgtctaggtcacgcccgaaggcctcgcccccgtcggtcacctctccgttccccggcccctcctccacgcgtatcgtctgagcgggctggcgaagcgcangnnnnnn

SEQ ID NO: 404111 - DNA, 729 bp, Homo sapiens
  misc_feature: GZ8MTXP01DFGW8.22.28.C06.1.454.CMB.2.raw
  modified_base (208)..(208): a, c, t, g, unknown or other
  modified_base (237)..(237): a, c, t, g, unknown or other
  modified_base (327)..(327): a, c, t, g, unknown or other
  modified_base (358)..(358): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcgagggtcctgggcccagtctgtgttgactcagcccaccctcagcgtcgtcgggaccccggnagacgggtcaccatctcttgttctggaancgactccaacagtcggcatactcatgtgtacgtcggtaaccaacgacggtcccgaacggggaccccgacccccaaactccctacatgtangacagtagtgacgccggcctggacgggtccngaccgtcttctcgtggctacgtaaacgtcgtcggcctaccgtccggccctcccgtggacacgtcgacggtccggcccgtccgggtaccggaaggtagttcgggacggtctacggttatttaacgttacgttggtacggacgtaacggtacctaagggttacgggtaaacctttaacccgaaaccgtttgggtaacgttacgttaccgtttaccggtttagggggtttaagggggttcgggtttccgggggaaaccgggggttaaccggggaaccggtacggggttaccgttccgggttaaccccggttcggtaacgggtaaccgaacccgggacccggttaaccgggtccccgttccccgggtccccccgg

SEQ ID NO: 404112 - DNA, 544 bp, Homo sapiens
  misc_feature: GZ8MTXP01BLKP7.22.28.C06.1.454.CMB.2.raw
  modified_base (364)..(364): a, c, t, g, unknown or other
  modified_base (536)..(544): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccgcccccaaactcctcatgtatgacagtagtgagcggccctcgacggggtccctgaccgattctctggctctaagtctggcacctcggcctccctggacatcagtggcctccggtccgaggatgaggctgattattactgtgcagcagtggacttacactgagtnaatctggttgggtgttcgggcgggagggaccaggctcgaccgttccgtagggtcgacgaccctaagggccttcggcccccgtcggtccaccgttcctcccgttccccaccccttcctccacggtctagtcgtctcggaggtccgggacgtcgggcaacgggcgacagttagnnnnnnnnn

SEQ ID NO: 404113 - DNA, 551 bp, Homo sapiens
  misc_feature: GZ8MTXP01EWYL4.22.28.C06.1.454.CMB.2.raw
  modified_base (541)..(551): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgacgcggccctcgagggggtccctgaccgattctctggctctaagtctggcacctcggcctcctggacatcagtcggcctccggtccgaggatgaggctgattatactgtgcagcagtggacttacactgagtgaacttccgtggttggggtcgttcgggcgggtagggaccagggctcgacccgtccgtacggtcacggcccgaacggccgtccgcccccgtcggtcctaccttccgttccgttccccaccccttcctccaccgtccgtagtcgtcgtagcggcgggctgggccgaagggcgcgattagnnnnnnnnnnn

SEQ ID NO: 404114 - DNA, 523 bp, Homo sapiens
  misc_feature: GZ8MTXP01AYUX9.22.28.C06.1.454.CMB.2.raw
  modified_base (506)..(506): a, c, t, g, unknown or other
  modified_base (510)..(511): a, c, t, g, unknown or other
  modified_base (513)..(523): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagccggccctcgagggggtccctgaccgattctctggctctaagtctggcacctcggcctccctggacatcagtggcctccggtccgaggatgaggctgattattactgtgcagcagtgggacttacactgagtgaatcgtgttgggtgttcgggcggagggacagctgaccgtcctaggtcacgcccgaaggcctcgcccccgtcggtccacctctcgttccccggccctcccgtacgcgtatgcgtggcggtcggcgtcggacgacgcganaggnngnnnnnnnnnnn

SEQ ID NO: 404115 - DNA, 527 bp, Homo sapiens
  misc_feature: GZ8MTXP01CU82B.22.28.C06.1.454.CMB.2.raw
  modified_base (512)..(512): a, c, t, g, unknown or other
  modified_base (514)..(527): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccaggggacgcccccaaactcctcatgtatgacagtagtgagcggccctcgaggggtccctgaccgattctctgggctctaagtctggcacctcggccctccctggacatcagtcggcctccggtccgaggatggaggctgattattactgtgcagcagtggattacactgagtgaacttcgtaaggttgggtgttcgggcggagggaccagggctgtaccgtccgtaggtcacgcccgaaggcctcgccccctggtcacgtctcgttcccgaccctcctccacgcgtatgtcgtgacgcgggctggcgaaggcttacgagngnnnnnnnnnnnnnn

SEQ ID NO: 404116 - DNA, 581 bp, Homo sapiens
  misc_feature: GZ8MTXP01C2WPZ.22.28.C06.1.454.CMB.2.raw
  modified_base (560)..(560): a, c, t, g, unknown or other
  modified_base (565)..(565): a, c, t, g, unknown or other
  modified_base (567)..(569): a, c, t, g, unknown or other
  modified_base (571)..(581): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggaccggcccccaaactcctcatgtatgacagtagtgagcggccctcgacggggtccctgaccgtattctctggctctaagtctggcaccgtcggcctccctggacatcagtcggcctcccggtccgaggatggacggctgatttatttacgtgtgcagctagtgggtacttacaactgagtgtaacttaccgttggtttggggtcgttcgggacggggacggggacccgaggccgtcggacccgtccggtaggcacgacccgaaggcctccgccccctcggctaccctctcccgttcccggtccccttccctaccgccgtcgttacgtcgtcgtcggcgggtcgggcgtcggacgaacgggcncaagngnnngnnnnnnnnnnn

SEQ ID NO: 404117 - DNA, 521 bp, Homo sapiens
  misc_feature: GZ8MTXP01ESBFI.22.28.C06.1.454.CMB.2.raw
  modified_base (406)..(406): a, c, t, g, unknown or other
  modified_base (449)..(449): a, c, t, g, unknown or other
  modified_base (463)..(463): a, c, t, g, unknown or other
  modified_base (487)..(487): a, c, t, g, unknown or other
  modified_base (509)..(509): a, c, t, g, unknown or other
  modified_base (511)..(512): a, c, t, g, unknown or other
  modified_base (514)..(521): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaatcctcatgtatgacagtagtgagccggccctgagggggtcccctgacccgtatttctctggactctaagtctggcacctcggccctccctggacatcagtgcctccggtccgagatgaggctgatttatactgtgcagcagtgggacttacaaactgagtgaatcctaagttgggtgttcgggcgggagggaccgnggctcggaccttcgtagtcagcccgaaggctcgcccctggccnctctccgttacccncccttcctcacgcgtctgtcgtgngtcgggcgtcggcgaacgcggngnngnnnnnnnn

SEQ ID NO: 404118 - DNA, 718 bp, Homo sapiens
  misc_feature: GZ8MTXP01DMKOD.22.28.C06.1.454.CMB.2.raw
  modified_base (208)..(208): a, c, t, g, unknown or other
  modified_base (333)..(333): a, c, t, g, unknown or other
  modified_base (339)..(339): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctctcactcactgtgcagggtcctgggcccagtctgtgttgactcagccaccctcagcgtctcggggaccccccgggnaggaggtcacctattcttcttgttcgtaggacgccgactaccaacagtccggactaatactctagtgtagtacgtacggtaaccaacgacggtcccgacgggaccccgaacccccaaactcctanatgtancgactagtagtgacgccggccgtacgacgggtcctacgaccgtcttcctcgtcggtccttacgtaaacgtccgtcggaccctacccggtcccggtcccctcccgtaggacctacgtcgtacggtccggtcccggtccgggtaccggaggtagtcgggacggtcgtagttaatttacgttacgtggtacggacgagtacgtaaggtaggtaacttaaccgaacgttaggtacgttcgtacgttccgggtttaggggtttcggggttcgggttccgggggacgggttaacggggaacccggtacgggttcgttaccggttacccgggtaaccgtagggtcccgacggacccggttaacgggtcccgttccccggtcccccg

SEQ ID NO: 404119 - DNA, 644 bp, Homo sapiens
  misc_feature: GZ8MTXP01C697F.22.28.C06.1.454.CMB.2.raw
  modified_base (313)..(313): a, c, t, g, unknown or other
  modified_base (331)..(331): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactcgccaacccctcctcgaggctcgagtcagcctgtcagtanacacgtaccaagaacccngaccttcccgtgacgacctcgacccctctgtcgacccgcccgacaacgccgacgggtccgttagttacttttcgtggtcggttaccgggttacgagttcgttaccgatacggactaacgtaccaaacaaacaaccgttcggtaccgtccggtacggggccggaacggggtaacccgtcggtccaccgtcctccctcaccgtccctccaaccgacgggccctaacgtccggttcccttccccgttggaccctcccgttccttcccagaacccgccgtaacccgtcggacggggcctaaccggaacggtcccggg

SEQ ID NO: 404120 - DNA, 702 bp, Homo sapiens
  misc_feature: GZ8MTXP01AHNVY.22.28.C06.1.454.CMB.2.raw
  modified_base (206)..(206): a, c, t, g, unknown or other
  modified_base (235)..(235): a, c, t, g, unknown or other
  modified_base (245)..(245): a, c, t, g, unknown or other
  modified_base (261)..(261): a, c, t, g, unknown or other
  modified_base (328)..(328): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtcgtcgggaccccggnaggaggtcaccatcttcttgttcaggaancgactccaantcggcatactcatgtntacgaggtaaccaacgacggtcccgacgggacccgacccccaaactccctacatgtatgacagtagnggacgcccggccgtcggacgggggtccctacgaccgtactttcctcgtcggtccttacgtaaacgttcgtcgggcctacccgtcggccccttccgtacgggactacgtcgtacggttccggccccgtccgggtaccggagggtatcgggtacgtcttaggtaactttacgttacgtggttagaccgtaggtcctaaggtacgggttaaactttaacccgaaagttacggtaagttcgtaacgtttccggtttaggggttggggttcggggtttaccgggggacggggttacgggacccgtaggggttccgttccggttacccggttccgtagggtccaacccggtccggacggtcccgttccccgggtcccccg

SEQ ID NO: 404121 - DNA, 514 bp, Homo sapiens
  misc_feature: GZ8MTXP01B3Z8N.22.28.C06.1.454.CMB.2.raw
  modified_base (503)..(514): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctgacggggtccctgaccgattctctggctctaagtctggcacctcggcctccctggacatcagtggccctccggtccgaggatggaggctgatttattactgtgcagcagtgggattacaactgagtgaatcctggttgggtgttcgggcggagggaccagggctgaccgtctaggtcagcccaaggctcgcccctcggcactctcgttccccaccctcctccacgctatcgtctgcggccgggctcggcaagggcgcattgnnnnnnnnnnnn

SEQ ID NO: 404122 - DNA, 721 bp, Homo sapiens
  misc_feature: GZ8MTXP01DHLRJ.22.28.C06.1.454.CMB.2.raw
  modified_base (207)..(207): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccacctcagcgtcgtcgggacccccggnaggagggtcaccatctcttgttctaggaagcgactaccaacagtccggcgtaatactcattgtagtacgtcggtaaccaacgacgggtacccgacggggaccccgacccccctaaactccctactagtacgtatcggaactaaggtacgtggacggcccggtccccgtacggtaccgggggttcccctggtaccgtactttcctcgtggtcctacgttaaacgtctcgggccctacccgttccgggcccctaccgtcgggacctacgtcgtacggtccgggtcccgtccgggaccggtaggaacgttggtacgggtcttacggtaactttaatttaccgtgtacgggtacgtagtacgtaggtacgggtaacttaccgaacgtaggtacgttcgtacgttccggttaggggttcgggttcgggttccggggacgggacgggtaccgtacgggttcgttccggttacccgttaacgtacggtccgaccggacccgacggtccgccccgtccccgg

SEQ ID NO: 404123 - DNA, 655 bp, Homo sapiens
  misc_feature: GZ8MTXP01DA2OG.22.28.C06.1.454.CMB.2.raw
  modified_base (258)..(258): a, c, t, g, unknown or other
  modified_base (342)..(342): a, c, t, g, unknown or other
  modified_base (640)..(641): a, c, t, g, unknown or other
  modified_base (643)..(651): a, c, t, g, unknown or other
  modified_base (653)..(653): a, c, t, g, unknown or other
  modified_base (655)..(655): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggaccgcccccaaactcctcatgtatgacagtagtgagcgccctgaggggtccctgaccgtnttctctggctctaagtctggcacctcggccctcccgtggacatcagtcgcctccggtcgaggatgaggctagattatactgtgnagcagtggtaaccttaacgaacgtggtagtcgtaaacgttccgttaaggggttcggggtacgtttccgggggacggggtaacggggaccgacgggtcgtaccggtacccgtaccgttacgggcaccggacccgaacggtccctacccggcccccgttcggtccctaaccgtttccgttacccgtttccccccgaacccctttcccgtaccgtacccggtaccgtttcgtcggttccgttacggggacggccggggtccgttaccggggacggtaacgggtcccggaaagtagacgcgnngnnnnnnnnngngn

SEQ ID NO: 404124 - DNA, 509 bp, Homo sapiens
  misc_feature: GZ8MTXP01D6IVG.22.28.C06.1.454.CMB.2.raw
  modified_base (496)..(496): a, c, t, g, unknown or other
  modified_base (503)..(509): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctcgaggggtccctgaccgtattctctggctctaagtctggcacctcggcctccctggacatcagtggcctccggtccgaggatgaggctgatttatactgtgcagcatgggacttacaactgagtgaaacttcgtggttgggtgttcgggcgggaggggaccagggctgacgtctagggtcagcccaaggctcgccccctggtcactctcgttcccaccctcctcacgcgtactgtctgcgcgggcgtggcaaggcgngattagnnnnnnn

SEQ ID NO: 404125 - DNA, 598 bp, Homo sapiens
  misc_feature: GZ8MTXP01EFKZ6.22.28.C06.1.454.CMB.2.raw
  modified_base (284)..(284): a, c, t, g, unknown or other
  modified_base (322)..(322): a, c, t, g, unknown or other
  modified_base (584)..(584): a, c, t, g, unknown or other
  modified_base (586)..(598): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgacggggtccctgaccgattctctggctctaagtctggcaacncggccctcctgaccatctctgggctccgaggctgaagntgaggctgatttatactgctgctctatttgcaggccgtcccttaaacgacgtttgggggtacgttccggggacgggaacgggacccaaaggccgttacggaaccccggttccgtaaggggtcacggaccccgaaagggtccctcccggcccccgttcgggtacctaccgtccgttccgttccccccggccccttcccgttccgaacccggtcgttacgtgttccgtaggacgggtcgggcgtcgggacgaagggcgcagtangnnnnnnnnnnnnn

SEQ ID NO: 404126 - DNA, 571 bp, Homo sapiens
  misc_feature: GZ8MTXP01AG2ZU.22.28.C06.1.454.CMB.2.raw
  modified_base (206)..(206): a, c, t, g, unknown or other
  modified_base (265)..(265): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccggnagagggtcaccatctcttgttctggaagcgactccaacatcggcatactcatgtgtacnggtaccaacgaggtcccagggaccggcccccaaactccctcatgtatgacagtagtgagcggccctcgacggggtccctagaccgtacttctcgtggtctcgtaaacgtctcgggccacccgtcggccctcccctgggactatcgagtcggcccgtccgggtccgaggtacgtggaggctgtattattactgtggcagcagtgggattacaaccgtgagtgactccgtaggttgggtggttcgggcggagggaccagggcgttcggacccgtctaggtcgacggcccgaggtccttccggtccccg

SEQ ID NO: 404127 - DNA, 531 bp, Homo sapiens
  misc_feature: GZ8MTXP01CNI00.22.28.C06.1.454.CMB.2.raw
  modified_base (399)..(399): a, c, t, g, unknown or other
  modified_base (487)..(487): a, c, t, g, unknown or other
  modified_base (518)..(531): a, c, t, g, unknown or other
tcagacatacgcgtcacgaccggtgctcgatttagagctcacgtattgggtttgggggccgtccctgggcccagtctgtgttgactcagcaaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggccctccctggacatcagtcggcctccggtccgaggatgaggctgattattactgtgcagcagtgggacttacactgagtgattccgtgttgggtgttcgggcggaggggaccngggctgaccgtcctaggtcacgcccgaaggcctcgccccctcggtcactctcgttccccaccctcctccaccgtcgtatcgtcgtcgnggtccgggctcgggcgaagggcgcgattggnnnnnnnnnnnnnn

SEQ ID NO: 404128 - DNA, 762 bp, Homo sapiens
  misc_feature: GZ8MTXP01C2GJD.22.28.C06.1.454.CMB.2.raw
  modified_base (206)..(206): a, c, t, g, unknown or other
  modified_base (253)..(253): a, c, t, g, unknown or other
  modified_base (279)..(279): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccacctcagcgtcgtcgggacccccggnaggacgggtcaaccattctcttgttcgaggaaacgcgactaccaaangtcgggacatactcagtgtacgtacnggtaaccaacgacggtcccgagggacccgacccccaaatcctacatgtatgacagtagtgacgccgcctagacggggtccctggacctacttcgtcgtcggtctacgtaaacgttcgtcggaccctacccgtcccgggtcccttccccgtagggaacctaacgtccgtagggtccgggtccccgttccggggtaccgaagggtaacgttcgggaagggtccgtaagttaaagtttaaacttacgttagttgggggaacctacggacgtaagggttaggggtaaacctttaaaccccgaaacgtaggtaacgttaggtaaaccctttcggttaagggggttttcgggggtacgggtttccgggggaaccgggggaacggggtaacccgtaacgggccgttaccggggttaccccgtttaaccggtacggggtaacccaaccggaccccggttaacggggtccccttccccggggttcccccccg

SEQ ID NO: 404129 - DNA, 534 bp, Homo sapiens
  misc_feature: GZ8MTXP01C3S9M.22.28.C06.1.454.CMB.2.raw
  modified_base (262)..(262): a, c, t, g, unknown or other
  modified_base (498)..(498): a, c, t, g, unknown or other
  modified_base (521)..(534): a, c, t, g, unknown or other
tcagacatacgcgtcacgaccggtgctcgatttagagctcacgtattgggtttgggggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggcccccaaactcctcatgtatgacagtagtgagcggccctcgagggggtccctgaccgattcnctggctctaagtctggcacctcggcctcctggacatcagtggcctccggtccgaggatggaggctagatttatactgtgcagcatgggacttacaactgagtgaatcgtggttgggtgttcgggcggagggaccagggctagaccgtcgtaggtcagcccgaaggcctcgcccccgtcggtcactcgtcgttcccctacccgtccctcacgtctactcgtcgtcggaggtccgggngtcggcgaagggcgctaagttgnnnnnnnnnnnnnn

SEQ ID NO: 404130 - DNA, 608 bp, Homo sapiens
  misc_feature: GZ8MTXP01EOZV8.22.28.C06.1.454.CMB.2.raw
  modified_base (592)..(592): a, c, t, g, unknown or other
  modified_base (594)..(596): a, c, t, g, unknown or other
  modified_base (598)..(608): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagccggccctcgacgggggtccctgaccgtattctctggctctaagtctggcacctcggccctcccgtggacatcagtcggcctccggtccgaggatggaggtctgatttattactgtgcagctagtgggtacttacaactgagtgaacttccgttaagggtttggggtggttcggggcggggacggggaccgagggtccgtcggaccgtccgtagggtcacgcccgaacggcctccgcccccgtcggtcctaccgttccgttcccggttcccccgggtccccttacccgtccgtacccggtcgttacgtcggttcgtacgggcggccggggtcgtcgggacgaacgggcggactaagngnnngnnnnnnnnnnn

SEQ ID NO: 404131 - DNA, 709 bp, Homo sapiens
  misc_feature: GZ8MTXP01A6S46.22.28.C06.1.454.CMB.2.raw
  modified_base (208)..(208): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggacccccggnaggagggtcaccatctcttgttctggaagcgactccaacatcggcatactcatgtgtactggtaaccaacgacggtcccgaggggaccccggaccccccaaaactccctctactgtatcgaacaggtagtgacggccggcccctggaccggggtccctcggaccgtacttcctcgtggtcctacgtaaacgttccgtcgggccctaccccgttccgggccccttccccgtgggacctacgtccacggttcggtcccgtcccgggtccggaggtacgttggaacggtcgttaggtatttaacttacgtgttaggcgtaagcgtaggttagggtaactttaaccgaaccgttgggtacgttcggtaacgttccgttaaggggtttcgggggttcgggttccgggggacgggacggggtacccgaggggttccgttacgggacccgttaacccggtcggtaacccgacggaccccgaagggtcccgttaacccggtcccccccg

SEQ ID NO: 404132 - DNA, 538 bp, Homo sapiens
  misc_feature: GZ8MTXP01EJBTI.22.28.C06.1.454.CMB.2.raw
  modified_base (369)..(369): a, c, t, g, unknown or other
  modified_base (476)..(476): a, c, t, g, unknown or other
  modified_base (521)..(521): a, c, t, g, unknown or other
  modified_base (524)..(524): a, c, t, g, unknown or other
  modified_base (526)..(538): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctcgagggggtccctgaccgattctctggctctaagtctggcacctcggcctccctggacatcagtggccctccggtccgaggactggaggctagatttattactgtgcagcagtgggtactacactgagtnaatctggttgggtgttcgggcgggacgggaccgagggctgacccgtcgtaggtcacgcccaaggcctccgccccgtcggtccacgtcttccgtccccacccttcccnccacgtcgtactgtcgtagcggcgggtcgacggcgaaggccgganagngnnnnnnnnnnnnn

SEQ ID NO: 404133 - DNA, 524 bp, Homo sapiens
  misc_feature: GZ8MTXP01D1VZQ.22.28.C06.1.454.CMB.2.raw
  modified_base (344)..(344): a, c, t, g, unknown or other
  modified_base (495)..(495): a, c, t, g, unknown or other
  modified_base (509)..(509): a, c, t, g, unknown or other
  modified_base (512)..(512): a, c, t, g, unknown or other
  modified_base (514)..(524): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccaggggaccgcccccaaactcctcatgtatgacagtagtgagccggccctcgacggggtccctgaccgattctctggctctaagtctggcacctcggcctccctggacatcagtggcctcggtccgaggatgaggctgatttattactgtgnagcagtgggattaccaactgagtgaaattcctggttgggtgttcgggcgggaggggaccagggctgaccgtcgtaggtcacgcccaaggctcgcccctcggcactctcgttcccggccctacctcaccgtcgtatgtctggcggcggtcgngggccgaaggccgngangnnnnnnnnnnn

SEQ ID NO: 404134 - DNA, 716 bp, Homo sapiens
  misc_feature: GZ8MTXP01BE22L.22.28.C06.1.454.CMB.2.raw
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtgctccatcagtgattactactggacctggactccggcagtccccagggcagggactggaatggattggattattccatacgactgcgatcgaccaactcgaccaacccctcctcgagggcctcgagtcagtcctgtcagtagacacgtaccaagaacccagtaccttcctagacgactcgaccccttctaggtcgacccgccgacgaacgccgaccgggtccgttagttacttttccccgtgggttacgggttaccgggttacgtagttcggttacccagttacgaacgtaacggttaaccaaacctaaaccgtaacgttcgggttacccttccgggttacggggacccgggtaacggggtaaccccgtcgggttaccctaccgttcccgtacccgtcgacccgtccctacccgaaacccgtaccgggtcccctaacgttccccggttaccctttcccccgttcggacccctaaccccttccgttacccaacgaaccgccgtaacccgttcggcggggacctaacgaaccggtccccggg

SEQ ID NO: 404135 - DNA, 571 bp, Homo sapiens
  misc_feature: GZ8MTXP01D2XWR.22.28.C06.1.454.CMB.2.raw
  modified_base (553)..(553): a, c, t, g, unknown or other
  modified_base (560)..(571): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccgcccccaaactcctcatgtatgacagtagtgagcggccctgacggggtccctgaccgattctctggctactaagtctggcaccctcggcctccctggacatcgaggtcggcccgtcccggtaccgaggatggacggtctagatttatacgtgtgcagcagtgggaacttaccaacgtgagtgaaacttccgttaagggttggggtgttcggggacggacggggtaccagggctacgaccgtccgtaggtcacgaccgaacggtctacccgccccgtcgtccacctccgtccgttcccggtcccctccgtaccacgtcgtacgtgttcgtcggcggcggtgcggacgaagggcncgattgnnnnnnnnnnnn

SEQ ID NO: 404136 - DNA, 553 bp, Homo sapiens
  misc_feature: GZ8MTXP01B2MVZ.22.28.C06.1.454.CMB.2.raw
  modified_base (540)..(553): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagccggccctcgagggggtccctgaccgattctctggctctaagtctggcacctcggcctccctggacatcagtggccctccggtccgaggactggaggctgatttatactgtgcagcagtgggacttacacgtgagtgactccgtgttggggtgttcgggcgggtacggggaccgagggctgtacccgtccgtagggtcgacgcccgaaggcctcgcccccgtcggtccactcttccgtccccggtcccctcctccgacgtcgtacgtcgtctcggacggtcggggctgggcgaaggcgcagttagnnnnnnnnnnnnnn

SEQ ID NO: 404137 - DNA, 567 bp, Homo sapiens
  misc_feature: GZ8MTXP01BSY3N.22.28.C06.1.454.CMB.2.raw
  modified_base (336)..(336): a, c, t, g, unknown or other
  modified_base (340)..(340): a, c, t, g, unknown or other
  modified_base (399)..(399): a, c, t, g, unknown or other
  modified_base (553)..(554): a, c, t, g, unknown or other
  modified_base (557)..(557): a, c, t, g, unknown or other
  modified_base (559)..(567): a, c, t, g, unknown or other
tcagacatacgcgtcacgaccggtgctcgatttagagctcacgtattggggtttgggggccgtccctgggcccagtctgtgttgactcagccaccctcagcgtcctgggacccccgggcagagggtcaccatctcttgttctggaagcgactccaacatcggcgatactcatgtgtactggtaccaacaggtcccagggaccggcccccaaactcctcatgtatgacagtagtgagcggccctcaggggtccctgaccgtagttctctggctctaagtctggcacctcggcctcctggacatcagtggccctcggtccgaggatgaggctgatttntacngtgcagcagtggggacttacactgagtgaatcctggttgggtgttcgggcggagggacngggctcgacgtccgtaggtccagtcccgaaggcctacggccccctcgggaccaccgtcgttccggttccccggacccttcccgtccgacggttccgtacgtcgttcgtcggtacggccgggtccgtcgggacgaacggccggaccaagttcgcnngcncnnnnnnnnn

SEQ ID NO: 404138 - DNA, 617 bp, Homo sapiens
  misc_feature: GZ8MTXP01A0N21.22.28.C06.1.454.CMB.2.raw
  modified_base (429)..(429): a, c, t, g, unknown or other
  modified_base (594)..(594): a, c, t, g, unknown or other
  modified_base (600)..(600): a, c, t, g, unknown or other
  modified_base (602)..(602): a, c, t, g, unknown or other
  modified_base (604)..(605): a, c, t, g, unknown or other
  modified_base (607)..(617): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagcggccctcgacggggtccctgaccgtattctcgtggctctaagtctggccacctcggccctccctggacatcgagtcggcccgttccggtccgaggtatggaggtctagtattattacgtgtgcagcagtggtaactacacgtgagtgaacttccgtggttgggtaggttcgggcgggaacgggccgagggtcncggtaccgtccgtacggtcgaccgtacccgaacggccgtccggcccccttcggtccctaccgttccgtttaccccggttccccctaccccgttcccgtccgtaccggtaccgttacggtcgtacgttacgggacgggtccgggttcgtcgggacggaacggccgnaacggngngnngnnnnnnnnnnn

SEQ ID NO: 404139 - DNA, 687 bp, Homo sapiens
  misc_feature: GZ8MTXP01D20RV.22.28.C06.1.454.CMB.2.raw
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggacgaccctgtccctcacctgcattgtctccggtgctccatcagtgattactactggacctggatccggcacgtccccgagggcagggactggaatggattggattatttccatacgactgcgatgaccaactcgccaaccccctcctcgagggctcgatcacgcctgtcagtacgacacgtaccaagaccagtaccttccagacactcgacccctctggtcgacccgccgaacgacgaaccggcggtaccgttgttactttcgtggtcgttacggtacgagtcgtccagtcgaactacgtacaaacaaaccgtacgttcgggtacctccgggttacggggacccgtaaacgggggtaaccccttgggtaccctaacccggttcctccccgtcgaacccggccccttaaccccaaccggtaaccgggcccctaacgtccccgggttccccttcccccgttacggcccctaaccccttccccgacgaaaccgccgtaacccgtccgttaccggggcgggggaccccaacggccgggtccccgggg

SEQ ID NO: 404140 - DNA, 619 bp, Homo sapiens
  misc_feature: GZ8MTXP01CYZZZ.22.28.C06.1.454.CMB.2.raw
  modified_base (209)..(209): a, c, t, g, unknown or other
  modified_base (248)..(248): a, c, t, g, unknown or other
  modified_base (316)..(316): a, c, t, g, unknown or other
  modified_base (411)..(411): a, c, t, g, unknown or other
  modified_base (547)..(547): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggacccccgggnaggagggtcaccatctcttgttctggaagcgactccaanatcggcatactcatgtgtactggtaccaagcggtcccgacgggaccgaccccccaaatcctcatgtancgacagtagtgacgccggcctgacgggtccctggaccgtcttccgtcgtggtccttctaaacgtcgtggccctacccgtcccgggcccttcccgnggacatcgaggtcggcccgtcgggtccgaggagtggaggcttgagtttacttacgtgttggactgactaggtggtaacttaccgaacgtaggtagtggtattccggttagggttggggttacggttcgggacgggngggaaaccgtggttaccggttcgacccggttctacgggtccgacggcccgaggtcccgttcccgtcccccgg

SEQ ID NO: 404141 - DNA, 762 bp, Homo sapiens
  misc_feature: GZ8MTXP01DH10W.22.28.C06.1.454.CMB.2.raw
  modified_base (187)..(187): a, c, t, g, unknown or other
  modified_base (264)..(264): a, c, t, g, unknown or other
  modified_base (746)..(746): a, c, t, g, unknown or other
  modified_base (748)..(750): a, c, t, g, unknown or other
  modified_base (752)..(762): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacnggtcccaggggaccgcccccaaactcctcatgtatgacagtagtgagccggccctgacggggtccctgaccgattcntggctactaagtctggcacctcggcctccgtggacatcgaggtcggccctccggtccgaggtatggacgggtcttaggtaacttttacgtttaccgttggtcgaccagtcgaaggttacggggtaaaccctttaacccgaaaaccgttggtaaacgttcgtaaaacccgttttacccggtttaagggggtttcgggggtttccgggtttacccgggggaacccgggggtaaaccgggggtaccccgaaagggggtcccgttacccggggtaaccccggtttacccggttaaacggggttaccgtaacccggtaacccccgaaacggggttccccgttccccggtccccccccgttacgggttaccctaacctttacccgttcccccggttacccccgtaaccccccttccgtacccgtaccggtaccgttaacgttcggtcgtaacgggcggccgggtacgtcggacgaacgggccagtagngnnngnnnnnnnnnnn

SEQ ID NO: 404142 - DNA, 528 bp, Homo sapiens
  misc_feature: GZ8MTXP01BPKNZ.22.28.C06.1.454.CMB.2.raw
  modified_base (468)..(468): a, c, t, g, unknown or other
  modified_base (470)..(470): a, c, t, g, unknown or other
  modified_base (476)..(476): a, c, t, g, unknown or other
  modified_base (485)..(485): a, c, t, g, unknown or other
  modified_base (505)..(505): a, c, t, g, unknown or other
  modified_base (514)..(516): a, c, t, g, unknown or other
  modified_base (518)..(528): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgatagtagtgagcggccctcgacggggtccctgaccgattctctggctctaagtctggcacctcggcctcctggacatcagtcggcctccggtccgaggatggaggctgattattactgtgcagcagtgggacttacactgagtgaattccgtggttgggtgttcgggcgggagggaccagggctcggaccgtcgtaggtcacgcccgaaggcctcgccccgtcggtcactctcgtcccgccttccncncgtctntcgtctcgngtcgggctcgggcgaaggcncagttacgnnngnnnnnnnnnnn

SEQ ID NO: 404143 - DNA, 518 bp, Homo sapiens
  misc_feature: GZ8MTXP01BPC24.22.28.C06.1.454.CMB.2.raw
  modified_base (389)..(389): a, c, t, g, unknown or other
  modified_base (508)..(508): a, c, t, g, unknown or other
  modified_base (510)..(518): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagccggccctcgacggggtccctgaccgtattctctggctctaagtctggcacctcggccctcctggacatcgagtcggcctccggtccgaggatgaggctgtattatactgtgcagcagtggacttacactgatgaatctggttgggtgtcgggnggaggcaggctgaccgtctggtcacgccaaggctcgcccctcggccacgtctccgttccccggcccttccgtccacgtcgtacgtcgtcgtaggcggcgggctcgggcgaaggcgcagngnnnnnnnnn

SEQ ID NO: 404144 - DNA, 522 bp, Homo sapiens
  misc_feature: GZ8MTXP01BAKGL.22.28.C06.1.454.CMB.2.raw
  modified_base (471)..(471): a, c, t, g, unknown or other
  modified_base (509)..(522): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctcgaggggtccctgaccgattctctggctctagtctggcacctcggcctccctggacatcagtcggcctccggtccgaggatggaggctgattatactgtgcagcagtggacttacaactgagtgaactcgtggttgggtgttcgggcgggtagggaccgagggcgtgaccgtccgtaggtcacgcccaaggctcgcccctggcactctcgtcccggccctcctcacgctntgtctggcgccgggctcggcgaacgggcgcgaagttgnnnnnnnnnnnnnn

SEQ ID NO: 404145 - DNA, 804 bp, Homo sapiens
  misc_feature: GZ8MTXP01AVDT0.22.28.C06.1.454.CMB.2.raw
  modified_base (208)..(208): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggacccccggnagagggtcaccatctcttgtctaggaagcgacctaccaacacgtccggacgtaattacctctaagttggtacgttaaccgtacgggtaaaccccaaaccggtaccgggtacccccgaaacggggggaaccccccggaacccccccctaaaacttccccgtactaagtttacgtaacgtacgaacgtaggttaggtcggaccggtcccgggtccccgtacgggtaccgggggtccctaggaacccgttcgttcctcgtcgggtaccttaccgtaaacgttccgtcggaccctacccggtcccgggtcccctccggtacggactacgtccgtaggtccggtcccgttacccgggacggaggtaagtcgggtacggtcgttacgttaagtttaacgttacgtcggtcggacgtaacggtacgtaaagggttcgggtaaaccttaaccgtaaccgtaggtacggttagttacgtttacggttaggggttcggggttcgggttacgggggacgggacgggtaaccgcgggttcccgttcgggttacccgtcgggtacggtcgaaccgggcccgttaacgggtcccgttcccggtcccccgg

SEQ ID NO: 404146 - DNA, 794 bp, Homo sapiens
  misc_feature: GZ8MTXP01COTQ4.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtctcgggacccccggcagagggtcaccatctcttgttctggaagcgactccaacatcggcgatactcatgtgtactggtaaccaacgacggtccccgaggggaccggaccccccaaaacttccctcatgtatgacaggtagtagaggtacggcccctcggacgggggtcccctacggaccgtactttccgtcgtgggtacccttacgtaaaacggttccgtcgggccctaacccgttcccggggaccccttcccccgtgggtaaacctacttccgtaacgggtccgggtccccgtcccggggttaccccggaagggtagttacggagggtccgttaggttaattttacggttaacctgggtcggggtactaacggccgttaggtacggggttaacttaaccgtaaaccgtttggaaaggttcggtaacgttcccgggttaaggtttcggggggtttcggttcggggggtaccggggttaacgggggaaacccggtcgggggttcccgttacggggttaccccgggtttaacccggttaaacggggtccccgaacgggtacccccggaaacggggtccccgttcccccggttccccccccgggg

SEQ ID NO: 404147 - DNA, 631 bp, Homo sapiens
  misc_feature: GZ8MTXP01BP4NV.22.28.C06.1.454.CMB.2.raw
  modified_base (208)..(208): a, c, t, g, unknown or other
  modified_base (237)..(237): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggacccccggnagagggtcaccatctcttgttctggaacncgactaccaacatcggacatactcatgtgtacgtcggtaaccaacgtacggtacccgacgggacccggaccccccaaactccctacatagtatcgacaaggtagtcgacgccggccctcggacggggtccctcgtaccgtacttcctcgtacggtcttacgtaaacgtccgtcggcctacccgtccgggtcccctcccgtaggactactcgtaggtccggtcccgtccgggtccgaggacgtggagtcgtagtattattacgtgtgacagctagtggtactacgtacgtagcgtgtacttcggtaggttcgggttggttcggggcgggacgggtacgcgggttcgttcgacccgtcgtcggtcgaccgcccggacgtcccgttcccgtccccgg

SEQ ID NO: 404148 - DNA, 618 bp, Homo sapiens
  misc_feature: GZ8MTXP01BEQ7T.22.28.C06.1.454.CMB.2.raw
  modified_base (598)..(598): a, c, t, g, unknown or other
  modified_base (604)..(604): a, c, t, g, unknown or other
  modified_base (606)..(618): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagcgccctcgacggggtccctgaccgattctctggctctaagtctcggcacctcggccctcctggacatcagtcggcctccgggtccgaggatgaggctgtacttatactgtgcagcagtggactacactgagtgaacttcgtggttggggtcggttcgggacggggtacgggacccgagggtccgtacgggtacccgttaccgtaacgggttccgaccggaccccgtaacgggcccgtacccggtcccccccgttcggggttcccctaaccgttccttacccggttcccccgtaccccttccccgttaccgacccggtccgttgtcggtcctcggcgggccggggtctcgggcgaacggggtcnctaagngnnnnnnnnnnnnn

SEQ ID NO: 404149 - DNA, 502 bp, Homo sapiens
  misc_feature: GZ8MTXP01CJN06.22.28.C06.1.454.CMB.2.raw
  modified_base (302)..(302): a, c, t, g, unknown or other
  modified_base (346)..(346): a, c, t, g, unknown or other
  modified_base (371)..(371): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (401)..(401): a, c, t, g, unknown or other
  modified_base (404)..(404): a, c, t, g, unknown or other
  modified_base (411)..(411): a, c, t, g, unknown or other
  modified_base (417)..(417): a, c, t, g, unknown or other
  modified_base (422)..(422): a, c, t, g, unknown or other
  modified_base (433)..(433): a, c, t, g, unknown or other
  modified_base (490)..(502): a, c, t, g, unknown or other
tcagacatacgcgtcacgaccggtgctcgatttagagctcacgtattgggtttgggggccgtccctggggcccagtctgtgttgactcagccaccctcagcgtctgggacccccgggcagaggggtcaccatctcttgttctggaagcgactccaacatcggcgatactcatgtgtactggtacccaacaggtcccagggacggcccccaaactcctcatgtatgacagtagtgagcggccctcgaggggtccctgaccgattcgtctggctctaagtctggcacctcggcctccctggacntcagtcggcctccggtccgaggatgaggctgatttattacgtgngcagcagtggtacttacactgagtnatctgtgggtgtcggngaggcngcngcgcngcngccagcncgcccncgtcnctctcgtcccncctcctcacgcgtgtcgtcgtggcggcgggctcgggcgaacggcgcagttgcccccnnnnnnnnnnnnn

SEQ ID NO: 404150 - DNA, 584 bp, Homo sapiens
  misc_feature: GZ8MTXP01AE1GL.22.28.C06.1.454.CMB.2.raw
  modified_base (230)..(230): a, c, t, g, unknown or other
  modified_base (262)..(262): a, c, t, g, unknown or other
  modified_base (295)..(295): a, c, t, g, unknown or other
  modified_base (321)..(321): a, c, t, g, unknown or other
  modified_base (336)..(336): a, c, t, g, unknown or other
  modified_base (339)..(339): a, c, t, g, unknown or other
  modified_base (563)..(563): a, c, t, g, unknown or other
  modified_base (565)..(565): a, c, t, g, unknown or other
  modified_base (567)..(567): a, c, t, g, unknown or other
  modified_base (569)..(569): a, c, t, g, unknown or other
  modified_base (572)..(572): a, c, t, g, unknown or other
  modified_base (575)..(582): a, c, t, g, unknown or other
  modified_base (584)..(584): a, c, t, g, unknown or other
tcagacatacgcgtcacgaccggtgctcgatttagagctcacgtattggggtttgggggccgtccctgggcccagtctgtgttgactcagccaccctcggcgtctgggacccccgggcagagggtcaccatctcttgttctggaagcgactccaacatcggcgatactcatgtgtactggtaccaacaggtcccagggaccgcccccaaatcctcatgtatgacagtagngagccggccctgaggggtccctgaccgattcnctggctctaagtctggcaccgtcggccctcccnggacatcagtcggcctccggtcgagntgagctgattatacngtncagcagtggacttaccgactgagtgattccgtagttgggtgtcggggcgggagggccagggctagacccgtcgtaggtcacgcccgaaggcctccgccccgtcggtccaccgttccgtaacccgtttccccgccccttccgtcctaccgtaccgttaacgtcggttccgtcggtaccgggccggggtcgtccggggaccgaacggggccgtaccgaaagtcggngngngngcncgnnnnnnnngn

SEQ ID NO: 404151 - DNA, 917 bp, Homo sapiens
  misc_feature: GZ8MTXP01BAV87.22.28.C06.1.454.CMB.2.raw
  modified_base (209)..(209): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcgagggtcctgggcccagtctgtgttgactcacgcccacctcagcgtcgtcgggacccccggnaggacgggtcaccatcttcttgttcctaggaagcgtactaccaacagtccgggacgtaattactctagttggtactaaccgtacggtaaacccaaaccggtaacgggttaccccccggaaagggggaaccccccggaacccccccctaaaaacttcccctaacccgtaaagttaggttaacgttacggaaacgtaaggttaggtacggaaccggtccccgggggtcccccttacggaaaccggggggtttcccccacggaacccgttacgtttcccctgggtacggtcccttacgttaaaaccggttccgttcggggacccttaaccccggttcccggggtcccccctttacccggacgggtaaaccactttaccggaaacggtttcccgggaccccggttaccccgggttcccgggaaaggttacggtagggaacggtccgttaaggttattttaaaccttacgttcggttagggaccgtagaccgtaaagggttacgggttaaaacgttaacctaaaccggttaggttagttaccggttaagttcccggtttaagggggtttgggttaccggggtttcggggaaccgggggttaacggtaaaccggtacgggccggtttaccgggaaccccggttaacggttacccggggtaaccaacccgggtaccccggttaaaccggggccctttcccccgggtccccccggg

SEQ ID NO: 404152 - DNA, 574 bp, Homo sapiens
  misc_feature: GZ8MTXP01BWNMO.22.28.C06.1.454.CMB.2.raw
  modified_base (207)..(207): a, c, t, g, unknown or other
  modified_base (235)..(235): a, c, t, g, unknown or other
  modified_base (406)..(406): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtctgggaccccccggnagagggtcaccatctcttgttctggaancgactccaacatcggcgatactcatgtgtactggtaaccaacacggtcccagggaccggcccccaaactcctcatgtatgacagtagtgagccggccctcgacgggggtcccctgacccgattcctcgtggcctctaaagtctggcacccgtcggccctccctggacatcngtcgccgtccggtccgagatggaggtctgattattacgtgtggcagcagtgggattacacgtgagtgtactccgtaggttcgggtggttccgggcggggttacgggaccgtaggccgttggacccggtcctacgggtccgacggacccgaggtccgttccgtcccccg

SEQ ID NO: 404153 - DNA, 602 bp, Homo sapiens
  misc_feature: GZ8MTXP01EMMLM.22.28.C06.1.454.CMB.2.raw
  modified_base (585)..(585): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcacgtccccagggcagggactggaatggattggatattccatacgactgcgatgaccaatcgcaacccctcctcagggctcgagtcagcctgtcagtagacacgtaccaagaacccagtacttccctgacgactgacccctcgtagtcgaccgccgacacgcacgggtccgtgttactttcgtggtcgttcgggtacgagtcgtccattcgacacgtacaacaaaactaactcggtcctccgtacggggccgaacgggtaaccccgtgggtcccaccgtcctccctcacggtccctaccgaaccgacgggccccaagttcccggttccctcccccgttgccctacccttccttccgaacgcgcaaccgtcggnggggcaacgcgcccggg

SEQ ID NO: 404154 - DNA, 646 bp, Homo sapiens
  misc_feature: GZ8MTXP01E31OH.22.28.C06.1.454.CMB.2.raw
  modified_base (207)..(207): a, c, t, g, unknown or other
  modified_base (251)..(251): a, c, t, g, unknown or other
  modified_base (266)..(266): a, c, t, g, unknown or other
  modified_base (313)..(313): a, c, t, g, unknown or other
  modified_base (351)..(351): a, c, t, g, unknown or other
tcagacatacgcgtcacgaccggtgctcgatttagagctcacgtattgggtttgggggagcttcagctgtggtagagaagacaggattcaggacaatctccagcatggccggcttccctctcctcctcaccctcctcactcactgtgcagggtcctgggcccagtctgtgttgactcagccaccctcagcgtcgtgggacccccggnaggagggtcaccatctcttgttctggaagcgactcaacatcggnatactcatgtgtacnggtaaccaacgacggtcccgaacggggacccgacccccaaacgtccncatgtatgacagtagtgacgccgcctcgacgggtcccngactcgttctgtcggctacgtaaagtctggacctaaaccgtcccggcccttccgagggactacgtcgaggtcgggccccgttccgggaccggagacgtggacggtctaggttatttaacttacgtgtacggacgtagactaggttacgggaacttaaccgaaccgttgacgttagtacgttcccggttaaggggtcggggtcggttcgggggacgggacgggaccgtaagggcgttccggttaacccgtcgtacgggcaccggtacccggaaggtcccgttccccgggtcccccg

SEQ ID NO: 404155 - DNA, 583 bp, Homo sapiens
  misc_feature: GZ8MTXP01AX4HZ.22.28.C06.1.454.CMB.2.raw
  modified_base (340)..(340): a, c, t, g, unknown or other
  modified_base (564)..(564): a, c, t, g, unknown or other
  modified_base (569)..(571): a, c, t, g, unknown or other
  modified_base (573)..(583): a, c, t, g, unknown or other
tcagacatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccgaccccccaaactcctcatgtatgacagtagtgagcgcctcgaggggtccctgaccgattctctggctactaagtctggcacctcggcctccctggacatcagtcggcctccggtccgagatgaggctagtattattangtgacagctagtggaacttaaccaactgagtgtaaacttccgtaaggttgggtacgttcgggacgggaggaccgagggtactcgaccgttaccgtaggccaccggacccgtaaagggcctcccgccccgttccggtactaccgttccgttcccgtcccccggtaccctccaccgtaacgtccgtatcggtactgggacgtccggggcgtacggacgaagtcganagagnnngnnnnnnnnnnn

SEQ ID NO: 404156 - DNA, 604 bp, Homo sapiens
  misc_feature: GZ8MTXP01EVN1R.22.28.C06.1.454.CMB.2.raw
  modified_base (590)..(592): a, c, t, g, unknown or other
  modified_base (594)..(604): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccgccccccaaatcctcatgtatgacagtagtgacgcggccctgacggggtccctgaccgtattctcgtggcttactagtctggccacctcggccctccgtggacatcagtcggcctccggtcgaggatggagctagtatttatctgtgcagcagtggactacacgtgagtgattcgtgggttgggtggtcgggcgggagggtacagggtctggaccgtcgttagggcacggacccgaacgggccttaccccggcccccgttacggtcccgtaaccttccggttccccgtttaccccccggggccctttaaccccgtccgtaccggtccgttcgtcggttcgtcgggacgggtccgggtacgtccggggacgaacgggtccacgtaagttgnnngnnnnnnnnnnn

SEQ ID NO: 404157 - DNA, 551 bp, Homo sapiens
  misc_feature: GZ8MTXP01BGRAL.22.28.C06.1.454.CMB.2.raw
  modified_base (297)..(297): a, c, t, g, unknown or other
  modified_base (302)..(302): a, c, t, g, unknown or other
  modified_base (346)..(346): a, c, t, g, unknown or other
  modified_base (371)..(371): a, c, t, g, unknown or other
  modified_base (407)..(407): a, c, t, g, unknown or other
  modified_base (414)..(414): a, c, t, g, unknown or other
  modified_base (500)..(500): a, c, t, g, unknown or other
  modified_base (531)..(531): a, c, t, g, unknown or other
  modified_base (538)..(539): a, c, t, g, unknown or other
  modified_base (541)..(551): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagccgccctgacggggtccctgaccgattctctggctctaagtctggcacctcggccctcccgnggacntcagtcggcctccggccgaggatgaggctgtattattacgtgtncagcagtaggacttacacgtgagtnaactcgttggttgggtggttcgggcgggtagggacngggtccngtacccgtacgtacggcgaccgcccgaacggcctcccggacccctcggtcctaccgtccttccccgttcccctctccgacctcgtntcgtcgtcggacggcggtcgtgcgtaaggcncgttagnngnnnnnnnnnnn

SEQ ID NO: 404158 - DNA, 739 bp, Homo sapiens
  misc_feature: GZ8MTXP01C27HP.22.28.C06.1.454.CMB.2.raw
  modified_base (285)..(285): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtgctccatcagtgattacactggacctggactccggcacgtcccagggcagggactggaatggattggatatttccatacgactgcgatgaccaatgccaacccctcccngagggctcgacgtcagccctggtaccaagtacgaacctacgtacccaaagaaaccctagacctttaccccgagacgactcgaccccttcgtacgtgacccgcgacaacgcgaccggtccgtagttacttcgtggttcgtacgggtacgtgtacggttaccagtgaactaagtaccaaacaaaacgtacgttacgggttacctaccggttacgggggaccccggaaacggggtaaccccgttacggggtaccctaaacccggttccgttccccgtaccaaccggtccccttaccccgtaaacccggaaaccggggtccccctaaacggtttccccgggttcccctttccccccgcgggtaccccctaacccccgttaccccgttaacccgaaacgggaaccttacccgcccggttaccgggtcgggggaccctaaccgggccggtcccccggggg

SEQ ID NO: 404159 - DNA, 716 bp, Homo sapiens
  misc_feature: GZ8MTXP01EYZO9.22.28.C06.1.454.CMB.2.raw
  modified_base (168)..(168): a, c, t, g, unknown or other
  modified_base (182)..(182): a, c, t, g, unknown or other
  modified_base (203)..(203): a, c, t, g, unknown or other
  modified_base (215)..(215): a, c, t, g, unknown or other
  modified_base (232)..(232): a, c, t, g, unknown or other
tcagacatacgcgtcacgaccggtgctcgatttagagctcacgtattgggtttggggagcttcagctgtggtagagaagacaggattcaggacaatctccagcatggccgcttccctctcctcctccaccctctcactcatgtgcaggtcctggcccagtctgtgttnactcagcccacctnagcgtcgtcgggacccccggnaggacgtcactntcttgttgtacgagacnctactacagtcgtcggactatctatagttcgtacgtacgtacggaaacaacgccggtaccggaaccggtaccccgaacccctaactccacgtagttacgagtacgacgtaagttacggacggaccggtccgtaccgtacggaccggttccctaggtaccgttcttccgtacgtcgtaccttacgtaacgttaccgtcggtaccctacccggtccgtacccgttacgacgacttacgacgtacgtccggtccggtaccggtacggtagtacggtacggtacgtacgtagttacgttaacgttacgtacgtcggtacgtacgtacgtacggtacggtaacgttaacgtaacgtacgtacgtacgtacgttacggttgggttcgggttacgggttacggggtacggggttacggtacggtacggttacggttaccgttaccgtaacgtacgtaacgtacggtaccgttaccgtccgttcccgtcccg

SEQ ID NO: 404160 - DNA, 558 bp, Homo sapiens
  misc_feature: GZ8MTXP01D78IE.22.28.C06.1.454.CMB.2.raw
  modified_base (241)..(241): a, c, t, g, unknown or other
  modified_base (344)..(345): a, c, t, g, unknown or other
  modified_base (537)..(537): a, c, t, g, unknown or other
  modified_base (545)..(558): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagccgccctnacggggtccctgaccgattctctggctctaagtctggcacctcggccctccctggacatcagcggccctccggtccgaggctgagctagatttattactgtgnngcagtggacttacaactgagtgaactcgtggttgggtgttcggcgggagggtacaggctcgcgtcgaggtcacgcccgaaggcgtccgcccccgtcggtcctactccgttaccgttccccggggtccccttcctccgaccgtcgtacgtcgttacgtcgacggtccggggtcgtgggcccgaaagggcccgntagttagnnnnnnnnnnnnnn

SEQ ID NO: 404161 - DNA, 596 bp, Homo sapiens
  misc_feature: GZ8MTXP01CDNPE.22.28.C06.1.454.CMB.2.raw
  modified_base (387)..(387): a, c, t, g, unknown or other
  modified_base (403)..(403): a, c, t, g, unknown or other
  modified_base (539)..(539): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgctcggtgctccatcagtgattacactggacctggatccggcagtccccagggcagggactggaatggattggatatttccatacgactgcatgaccaatgccaacccctcctcagggctcgagtcagcctgtcagtagacacgtacaagaaccagaccttcctgagactgacccctcgtagtcgacccgccgacacgcgacgggtccgtgtactttcgnggttcgtcggttacgngtgtcatgacacgtacaacaacgaactcgtacgtccgtacggggaccgacgggtaacccgtgggtaccctacgtcctcctcgaacgccctaccacgaaccgggccctaacgtccggttccgtccccgttcggaccnccccgttaccttccgaacgtaacgctaaccgtcgtcggggacctaacgcggcccggg

SEQ ID NO: 404162 - DNA, 614 bp, Homo sapiens
  misc_feature: GZ8MTXP01BHS90.22.28.C06.1.454.CMB.2.raw
  modified_base (280)..(280): a, c, t, g, unknown or other
  modified_base (303)..(303): a, c, t, g, unknown or other
  modified_base (394)..(394): a, c, t, g, unknown or other
  modified_base (558)..(558): a, c, t, g, unknown or other
  modified_base (600)..(602): a, c, t, g, unknown or other
  modified_base (604)..(614): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgatagtagtgagccggccctcgaggggtccctgaccgtattctctggctctaagtcnggccaccgtcgcctccctggacntcgagtcggcccgtccggtccgaggatggacggtctagtaactttattactggtcgacacgtcagtcgggtaacttaccgaacgtgtagtnaacgttcgttaagggttggggtcgttacggggcggtaaggggaccctgggtctacggcccgtacgtacgtcgaccgcccgaacggtccgtacccggtccccgtacgtccaccgttcgttcccggttccccgcccttaccgtccgaccgtcgttcgtacgttcgngggacggtcgggtcgtcgggaacgaacggccgagtagttcgnnngnnnnnnnnnnn

SEQ ID NO: 404163 - DNA, 568 bp, Homo sapiens
  misc_feature: GZ8MTXP01DKDB6.22.28.C06.1.454.CMB.2.raw
  modified_base (278)..(278): a, c, t, g, unknown or other
  modified_base (333)..(333): a, c, t, g, unknown or other
  modified_base (406)..(406): a, c, t, g, unknown or other
  modified_base (507)..(507): a, c, t, g, unknown or other
  modified_base (556)..(568): a, c, t, g, unknown or other
tcagacatacgcgtcacgaccggtgctcgattttagagctcacgtattggggtttgggggggcccgtccctggggcccagtctgtgttgactcagcccaccctcagcgtctggggacccccgggcagagggtcaccatctcttgttctggaagcgactccaacatcggcgatactcatgtgtactggtaccaacaggtcccaggggaccgccccaaactcctcatgtatgacagtagtgagcggccctcgaggggtccctgaccgtattctctggctntaagtctggcaccctcggccctcccctggacatcaggtgccctccggtccgaggntggaggctagtatttattactgtgtcagtcagtcggacttaacactgatgaactcttggtgggtgttacgggnggagggaccgtagggctgacccgtcgtacggtcacgacccaacggtcctccgtccccctcggttccacgttctcgttccccctaccctcccctccacccgngttctacggttcgtcgaggccggggctcggggccaaaggcgcaagttgnnnnnnnnnnnnn

SEQ ID NO: 404164 - DNA, 499 bp, Homo sapiens
  misc_feature: GZ8MTXP02G23VB.22.28.C06.1.454.CMB.2.raw
  modified_base (491)..(499): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggccctccggtccgaggatgaggctgattattactgtgcagcatgggattacaacctgagtgatcctgttgggtgttcgggcggagggaccagggctgaccgtctaggtcagcccaaggctcgccccctcggtcactctcgttcccgccctcctcacgcgtatgtctgagcggctggcacggcgcatagnnnnnnnnn

SEQ ID NO: 404165 - DNA, 503 bp, Homo sapiens
  misc_feature: GZ8MTXP02IDT34.22.28.C06.1.454.CMB.2.raw
  modified_base (495)..(503): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtcccctgaccgattctctggctctaagtctggcacctcggcctccctggacatcagtggcctccggtccgaggatgaggctgattattactgtgcagcatgggattacaacctgagtgatcctggttgggtgttcgggcggaggggaccagggctgaccgtctaggtcagcccaaggcctcgccccctcggtcactctcgttcccaccctcctcacgcgtatgtctgagcgggctggcaaggcgcatagnnnnnnnnn

SEQ ID NO: 404166 - DNA, 493 bp, Homo sapiens
  misc_feature: GZ8MTXP02G23BN.22.28.C06.1.454.CMB.2.raw
  modified_base (485)..(493): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtgcctccggtccgaggatgaggctgattattactgtgcagcatgggattacactgagtgatctgttgggtgttcggcggagggaccaggctgaccgtcctaggtcagcccaaggctcgccccctggtcactctcgttcccgccctcctcacgctatgtctgagcgggctggcaacggcgcatagnnnnnnnnn

SEQ ID NO: 404167 - DNA, 493 bp, Homo sapiens
  misc_feature: GZ8MTXP02FXHOX.22.28.C06.1.454.CMB.2.raw
  modified_base (480)..(480): a, c, t, g, unknown or other
  modified_base (486)..(493): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattatactgtgcagcatgggattacactgagtgatctgttgggtgttcggcggagggaccagggctgaccgtcctaggtcagcccaggctcgccccctggtcactctcgttcccgccctcctcacgcgtatgtctgagcgggctggcaaggcncatagnnnnnnnn

SEQ ID NO: 404168 - DNA, 508 bp, Homo sapiens
  misc_feature: GZ8MTXP02IG75D.22.28.C06.1.454.CMB.2.raw
  modified_base (501)..(508): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagcggccctgaggggtccctgaccgattctctggctctaagtctggcacctcggcctccctggacatcagtggccctccggtccgaggatgaggctgattattactgtgcagcatggacttacacctgagtgatcctggttgggtgttcgggcggaggggaccagggctgaccgtcctaggtcagcccaaggcctcgccccctcggtcactctcgttccccaccccttcctcacgcgtatgtctgagcgggctggcaacggcgcatagnnnnnnnn

SEQ ID NO: 404169 - DNA, 527 bp, Homo sapiens
  misc_feature: GZ8MTXP02IPK4Q.22.28.C06.1.454.CMB.2.raw
  modified_base (459)..(459): a, c, t, g, unknown or other
tcagacatacgcgtcacgaccggtgctcgatttagagctcacgtattgggtttggggagcttcagctgtggtagagaagacaggattcaggacaatctccagcatggccggcttcccctctcctcctcaccctcctcactcactgtgcagggtcctgggcccagtctgtgttgactcagccaccctcagcgtctggggacccccggcagagggtcaccatctcttgttctggaagcgactccaacatcggcatactcatgtgtactggtaccaacaggtcccagggaccgcccccaaactcctcatgtatgacagtagtgagcggccctcgacggggtccctgaccgattcctctggctctaagttctggcacccgtcggccctccctggacatcagtcggcctccgggtccgaggatgaggctgattattactgtgcagcagtggattacactgagtnatctagttggtgttcggcggtaggacaggcgtgaccgtccgtaggtcacgcccgaaggtctcgccccg

SEQ ID NO: 404170 - DNA, 524 bp, Homo sapiens
  misc_feature: GZ8MTXP02FHRRB.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtccccagggaccggcccccaaactcctcatgtatgacagtagtgagcggccctcgaggggtccctgaccgattctctggctctaagtctggcacctcggcctccctggacatcagtggccctccggtccgaggatgaggctgattattactgtgcagcatgggattacaactgagtgatcctagttgggtgttcggcggagggaccgaggctgaccgtcctaggtcacgcccaaggctcgcccccg

SEQ ID NO: 404171 - DNA, 494 bp, Homo sapiens
  misc_feature: GZ8MTXP02HEJEJ.22.28.C06.1.454.CMB.2.raw
  modified_base (460)..(460): a, c, t, g, unknown or other
  modified_base (466)..(466): a, c, t, g, unknown or other
  modified_base (488)..(494): a, c, t, g, unknown or other
tcagacatacgcgtcacgaccggtgctcgatttagagctcacgtattgggtttgggccgtccctgggcccagtctgtgttgactcagccaccctcagcgtctgggaccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcacctcggcctcctggacatcagtggcctccggtccgaggatgaggctgattattactgtgcagcatgggattacacctgagtgatcctagttggggtgttcggcggaggggaccagggctgaccgtcctaggtcagcccaaggctgccccctggtcactctcgttccccgccctcctcacgcgtangtctgngcgggctggcaaggcgcatagnnnnnnn

SEQ ID NO: 404172 - DNA, 505 bp, Homo sapiens
  misc_feature: GZ8MTXP02IGV37.22.28.C06.1.454.CMB.2.raw
  modified_base (241)..(241): a, c, t, g, unknown or other
  modified_base (470)..(470): a, c, t, g, unknown or other
  modified_base (478)..(478): a, c, t, g, unknown or other
  modified_base (483)..(483): a, c, t, g, unknown or other
  modified_base (492)..(492): a, c, t, g, unknown or other
  modified_base (494)..(494): a, c, t, g, unknown or other
  modified_base (496)..(505): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgccccccaaactcctcatgtatgacagtagtgagcggccctnaggggtcccctgaccgattctctggctctaagtctggcacctcggcctccctggacatcagtggcctccggtccgaggatgaggctgattattactgtgcagcatgggattaacaacctgagtgatcctaggttgggtgttcggggcgagggggaccagggctgaccgtcctaggtcagcccaaggctgccccctggtcactctcgttcccacccttcctcacgcgtangtctgagnggcgngcgacgcgnanannnnnnnnnn

SEQ ID NO: 404173 - DNA, 499 bp, Homo sapiens
  misc_feature: GZ8MTXP02F99TB.22.28.C06.1.454.CMB.2.raw
  modified_base (492)..(499): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatggggattacaacctgagtgatcctagttgggtgttcggcggaggggaccaggctgaccgtcctaggtcagcccaaggctgccccctcggtcactctcgttcccgccctcctcacgcgtatgtctgagcgggctggcaaggcgcatagnnnnnnnn

SEQ ID NO: 404174 - DNA, 679 bp, Homo sapiens
  misc_feature: GZ8MTXP02I9SBT.22.28.C06.1.454.CMB.2.raw
  modified_base (249)..(249): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctccctccaccctcctcactcactgtgcagggtcctgggcccaggtctgtagttgactcagccaccctcagcgtctgggacccccggcagagggtcaccatctcttgttctggaagcgactccaaacntcggcatactcatgtgtactcggtaaccaacgacggtcccgacggggacccggaccccctaaacctcctcatgtatgacagtagtgacggccggccctcgacggggtccctgaccgtacttccgtcgtcgtaccttacgtaacgtcgtcggcctaccgtccgtcccgtcccgtcgacactacgtacgtcggtcccgtccggtccggacggacgtcggacggtcgtacgtagttacttacgtcgtcgtcgtcgttcgttacgttcgtcgtacggtaccgtacccgtaccgttacggttcggggttcgggttcggggtaccggggtacgggtaaccggaacggtaccggtaccggtacccggtacccggtaccggtaccgtaaccgacccgaaccggtaccgtcccgtcccccggtcccggtacccgtaccg

SEQ ID NO: 404175 - DNA, 506 bp, Homo sapiens
  misc_feature: GZ8MTXP02JY064.22.28.C06.1.454.CMB.2.raw
  modified_base (497)..(506): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggccccaaactcctcatgtatgacagtagtgagcggccctcgaggggtccctgaccgattctctggctctaagtctggcacctcggcctccctggacatcagtggcctccggtccgaggatgaggctgattattactgtgcagcatgggattacactgagtgatctgtgggtgttcggcggagggaccagggctgaccgtcctaggtcacggcccaaggcctcgccccctcggtcactctcgttcccgccctcctcacgcgtatcgtctgacgcgggctgggcaaggcgcagtagnnnnnnnnnn

SEQ ID NO: 404176 - DNA, 513 bp, Homo sapiens
  misc_feature: GZ8MTXP02IJE8Q.22.28.C06.1.454.CMB.2.raw
  modified_base (505)..(513): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagcggccctcgaggggtcccctgaccgattctctggctctaagtctggcacctcggcctccctggacatcagtggccctccggtccgaggatgaggctgattattactgtgcagcatgggattacacctgagtgattcctggttgggtgttcgggcggaggggaccagggctgaccgtccgtaggtcagcccaaggcctcgcccccgtcggtcactctcgttccccgccctcctcacgcgtatcgtctgagcgggctgggcacggcgcatagnnnnnnnnn

SEQ ID NO: 404177 - DNA, 500 bp, Homo sapiens
  misc_feature: GZ8MTXP02FY5PH.22.28.C06.1.454.CMB.2.raw
  modified_base (494)..(500): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattatactgtgcagcatgggattacacctgagtgattcctagttgggtgttcgggcggaggggaccagggctgaccgtcctaggtcagcccaaggctgccccctggtcactctcgttcccgccctcctcacgcgtatgtctgagcgggctgggcaagggcgcatagnnnnnnn

SEQ ID NO: 404178 - DNA, 507 bp, Homo sapiens
  misc_feature: GZ8MTXP02H58IV.22.28.C06.1.454.CMB.2.raw
  modified_base (362)..(362): a, c, t, g, unknown or other
  modified_base (376)..(376): a, c, t, g, unknown or other
  modified_base (471)..(471): a, c, t, g, unknown or other
  modified_base (483)..(483): a, c, t, g, unknown or other
  modified_base (499)..(507): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcacctcggcctccctggacatcagtggccctccggtccgaggatgaggctgattattactgtgcagcatgggattacaacctgagtnatcctgttggggtnttcgggcggaggggaccgaggctcgaccgtccgtaggtccagcccaaaggcctcgccccctcggtcactctcgttcccaccctcctcacgcgtangtctgagcgggntggcaaggcgcatagnnnnnnnnn

SEQ ID NO: 404179 - DNA, 505 bp, Homo sapiens
  misc_feature: GZ8MTXP02IFAW4.22.28.C06.1.454.CMB.2.raw
  modified_base (239)..(239): a, c, t, g, unknown or other
  modified_base (489)..(489): a, c, t, g, unknown or other
  modified_base (495)..(505): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctnaggggtccctgaccgattctctggctctaagtctggcacctcggcctccctggacatcagtggccctccggtccgaggatgaggctgattattactgtgcagcatgggattacaacctgagtgatctagttgggtgttcgggcgaggggaccagggctgaccgtcctaggtcagcccaaggcctgccccctggtcactctcgttccccacccttcctcacgcgtatgtctgagcgggctgggcaagggcncatagnnnnnnnnnnn

SEQ ID NO: 404180 - DNA, 504 bp, Homo sapiens
  misc_feature: GZ8MTXP02HVIJI.22.28.C06.1.454.CMB.2.raw
  modified_base (242)..(242): a, c, t, g, unknown or other
  modified_base (495)..(504): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctnaggggtccctgaccgattctctggctctaagtctggcacctcggccctccctggacatcagtggccctccggtccgaggatggaggctgattattactgtgcagcagtgggacttacaacctgagtgatctggttgggtgttcggcggagggaccaggctgaccgtcgtagtcagcccaggcctcgccccctcggcactctcgttcccaccctctcacgcgtatcgtctgcgcgggctggacacggcgcatgnnnnnnnnnn

SEQ ID NO: 404181 - DNA, 543 bp, Homo sapiens
  misc_feature: GZ8MTXP02HRG8T.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaaacatcggcgatactcatgtgtactggtaccaacaggtcccagggaccgcccccaaactcctcatgtatgacagtagtgagcggccctcgaggggtcccctgaccgacttctctggctctaagtctggccacctccggccctcccgtggactatcagtcggccctccgggtccgaggatggagtctgtattattactgtgcagcagtggattacaactgagtgatccgtagttgggtgtttcgggcgggacggaccgaggctcggaccgtcgtaggtcacgacccgacggcctcgcccccg

SEQ ID NO: 404182 - DNA, 488 bp, Homo sapiens
  misc_feature: GZ8MTXP02HHB5E.22.28.C06.1.454.CMB.2.raw
  modified_base (368)..(368): a, c, t, g, unknown or other
  modified_base (482)..(488): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcaacacggcctccctgaccatctctgggctccaggctgaagatgaggctgattattactgctgctcatttgcaggcgcctacacttggggtnttcgggcggaggggaccaagctgaccgtctaggtcagcccaaggctcgccccctcggtcactctcgtcccgcctcctcacgcgtatgtctgagcgggctggcaaggcgcatagnnnnnnn

SEQ ID NO: 404183 - DNA, 535 bp, Homo sapiens
  misc_feature: GZ8MTXP02GJKE4.22.28.C06.1.454.CMB.2.raw
  modified_base (305)..(305): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggaccccccggcagagggtcaccatctcttgttctggaagcgactccaacatcggcgatactcatgtgtactggtaccaacgaggtcccagggaccggcccccaaactccncatgtatgacagtagtgagcggccctcgacggggtccctgaccgacttctctggctctaagtctggcacctcggccctccctggacatcagtggccctccggtccgagatgagctgattattactgtgcagcagtggatacactgagtgatcgtaggttggtcgttggcggtaggaccgaggcgtcgaccgtccgtaggtaccacgacccgaacggtccaccgtcccccg

SEQ ID NO: 404184 - DNA, 554 bp, Homo sapiens
  misc_feature: GZ8MTXP02HPKKJ.22.28.C06.1.454.CMB.2.raw
  modified_base (350)..(350): a, c, t, g, unknown or other
  modified_base (448)..(448): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccggcagagggtcaccatctcttgttctggaagcgactccaacatcggcgatactcatgtgtactggtaccaacaggtcccagggaccgccccaaactcctcatgtatgacagtagtgagcgccctgacggggtccctgaccgtattcncgtggcttctaagtctgggccaccgtcgcccctcccgtggacactcagtcggtcccgtccgggtccgaggagtggacggctgtattattacgtgtgcngcagtaggtatacacgtgacgtgactcgtaggttgggtggttcggacgggtaggaccgaggtcgtacggaccgtccgtaggctacgaccgacggcctcgtcccccg

SEQ ID NO: 404185 - DNA, 504 bp, Homo sapiens
  misc_feature: GZ8MTXP02F58X9.22.28.C06.1.454.CMB.2.raw
  modified_base (497)..(504): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacactgagtgatctgtgggtgttcgggcggagggacagggctgaccgtcctaggtcagcccgaaggctcgccccctcggtcactctcgttccccaccctcctcacgcgtactgtctggagtcggcgtggaccgaaggcgcagtagnnnnnnnn

SEQ ID NO: 404186 - DNA, 502 bp, Homo sapiens
  misc_feature: GZ8MTXP02I37EM.22.28.C06.1.454.CMB.2.raw
  modified_base (488)..(488): a, c, t, g, unknown or other
  modified_base (495)..(502): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctgttgggtgttcggcggagggaccagggctgaccgtcctaggtcagcccaaggctcgccccctcggtcactctcgttcccaccctcctcacgcgtatcgtctgagtcgggctggcaaggcncgatagnnnnnnnn

SEQ ID NO: 404187 - DNA, 516 bp, Homo sapiens
  misc_feature: GZ8MTXP02GVGTG.22.28.C06.1.454.CMB.2.raw
  modified_base (468)..(468): a, c, t, g, unknown or other
  modified_base (507)..(516): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccgacatcggcgatactcatgtgtactggtaccaacaggtctcagggacggcccccaaactcctcatgtatgacagtagtgagcggccctcaggggtccctgaccgattctctggctctaagtctggcacctcggcctccctggacatcagtcggcctccggtccgaggatggaggctgatttattactgtgcagcatgggattacacctgagtgatcctagttgggtgttcgggcgggtagggaccagggctcgaccgtcgtaggtcagcccgaaggctcgccccctcggtccactctcgttccccaccctcctcnccgcgtactgtctgacgcgggctggcgaggcgcatacgnnnnnnnnnn

SEQ ID NO: 404188 - DNA, 493 bp, Homo sapiens
  misc_feature: GZ8MTXP02IQ9B6.22.28.C06.1.454.CMB.2.raw
  modified_base (487)..(493): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctccctggacatcagtggccctcggtccgaggatgaggctgattatactgtgcagcatgggattacactgatgatcctggtgggtgttcggcgaggggaccagggctgaccgtcctagtcagcccaaggctgccccctcggtcactctgttcccgccctcctcacgccgtatgtctgagcggctgggcaaggcgcagtagnnnnnnn

SEQ ID NO: 404189 - DNA, 516 bp, Homo sapiens
  misc_feature: GZ8MTXP02ICX94.22.28.C06.1.454.CMB.2.raw
  modified_base (504)..(516): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctcgaggggtcccctgaccgattctctggctctaagtctggcacctcggcctccctggacatcagtggccctccggtcgaggatgaggctgattattactgtgcagcatgggacttacactgagtgattctggttgggtgttcgggcgaggggccagggctgcgtcctaggtcacgcccaaggcctcgccccctcggtccacctcctcgttccccacccttccctcacgcgtatcgtctgacggcggctgggcgaacggcgcatagnnnnnnnnnnnnn

SEQ ID NO: 404190 - DNA, 549 bp, Homo sapiens
  misc_feature: GZ8MTXP02G37BC.22.28.C06.1.454.CMB.2.raw
  modified_base (463)..(463): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccgggcagagggtcaccatctcttgttctggaagcgactccaacatcggcgatactcatgtgtactggtaccaacaggtcccagggaccgccccaaactcctcatcgtatgacagtagtgagccggcctcgacggggtccctgaccgattctctggctctaagtctcggcacctcgcctcccgtgacatcagtcgccctcggtccgaggatcggagctagattacttactgtgcagctagtaggtattaacgaacgtgagtnatcgttaggttgggtggttcgggacggagggacacgggtctcggtaccgtaacgttacggcgacgaccgacggcctcggtcccccg

SEQ ID NO: 404191 - DNA, 512 bp, Homo sapiens
  misc_feature: GZ8MTXP02HW0H5.22.28.C06.1.454.CMB.2.raw
  modified_base (503)..(512): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcagtgggattacaacctgacgtgatcctggttgggtgttcgggcgggtaggggaccagggctgaccgtccgtaggtcagccccgaaggcctcgccccctcggtcactctcgttcccgccctcctcacgcgtactgtctgacggcggctggcacggcgcatgnnnnnnnnnn

SEQ ID NO: 404192 - DNA, 495 bp, Homo sapiens
  misc_feature: GZ8MTXP02JE0JC.22.28.C06.1.454.CMB.2.raw
  modified_base (491)..(495): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctccctggacatcagtggcctccggtccgaggatgaggctgattattactgtgcagcatgggattacaacctgagtgatcctgttgggtgttcgggcggagggaccagggctgaccgtctaggtcagcccagcctgccccctcggtcactctcgttcccgccctcctcacgcgtatcgtctgacgcgggctggcaggcgcatgnnnnn

SEQ ID NO: 404193 - DNA, 511 bp, Homo sapiens
  misc_feature: GZ8MTXP02HEBNO.22.28.C06.1.454.CMB.2.raw
  modified_base (500)..(511): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagccggccctgaggggtccctgaccgattctctggctctaagtctggcacctcggcctccctggacatcagtggcctccggtccgaggatgaggctgattattactgtgcagcagtgggattacacctgagtgatcctggttgggtgttcgggcggaggggaccagggctgaccgtcctaggtcagcccaaggcctcgcccccgtcggtcactctcgttccccaccctcctcacgcgtatgtctgagcgggctggccaaggcgcgatagnnnnnnnnnnnn

SEQ ID NO: 404194 - DNA, 498 bp, Homo sapiens
  misc_feature: GZ8MTXP02J08QN.22.28.C06.1.454.CMB.2.raw
  modified_base (491)..(498): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgatgatcctagttggggtgttcggcggagggaccaggctgaccgtcctaggtcagcccaaggctgccccctcggtcactctgttccccaccctcctcacgcgtatgtctgagcgggctggcacggcgcatagnnnnnnnn

SEQ ID NO: 404195 - DNA, 505 bp, Homo sapiens
  misc_feature: GZ8MTXP02GZU4C.22.28.C06.1.454.CMB.2.raw
  modified_base (361)..(361): a, c, t, g, unknown or other
  modified_base (495)..(505): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggccctccggtccgaggatgaggctgattattactgtgcagcatgggaacttaaaaccngagtgatcctagttgggtgttcggcggagggccaggctgaccgtctaggtcagcccaagctcgcccctcggtcactctcgtccccaccctcctcacgcgtatcgtctgagcgggctggcgaacggcgcagtagnnnnnnnnnnn

SEQ ID NO: 404196 - DNA, 545 bp, Homo sapiens
  misc_feature: GZ8MTXP02ILK2E.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaacatcggcgatactcatgtgtactggtaccaacaggtcccagggaccgcccccaaactcctcatgtatgacagtagtgagcggccctcgaggggtccctgaccgacttctctggctctaagtctggctaccgtccggccctcccgtggaccatcagtcggccctccgggtccgaggactggaggctgattattacgtgtgctagcagtgggattacaactgagtgatcgtaggttgggtgttcgggcggtagggaccgaggcgtgaccgtccgtaggtcgacgcccgaacggccgtcgcccccg

SEQ ID NO: 404197 - DNA, 526 bp, Homo sapiens
  misc_feature: GZ8MTXP02I9ZKT.22.28.C06.1.454.CMB.2.raw
  modified_base (321)..(321): a, c, t, g, unknown or other
  modified_base (517)..(526): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctccctggacatcagtggcctccggtccgaggntgaggctgattattactgtgcagcagtggacttacaacctgagtgattcctaggttgggtgttcgggcgggagggaccgagggctcgaccgtcctaggtcagcccaaggcctcgcccccgtcggtcacctcctcgttccccgccccttcctcacgcgtactcgtcgtgaggccgggctgggcaacggcgacagagnnnnnnnnnn

SEQ ID NO: 404198 - DNA, 563 bp, Homo sapiens
  misc_feature: GZ8MTXP02HXE0C.22.28.C06.1.454.CMB.2.raw
  modified_base (206)..(206): a, c, t, g, unknown or other
  modified_base (263)..(263): a, c, t, g, unknown or other
  modified_base (276)..(276): a, c, t, g, unknown or other
  modified_base (302)..(302): a, c, t, g, unknown or other
  modified_base (387)..(387): a, c, t, g, unknown or other
  modified_base (391)..(391): a, c, t, g, unknown or other
  modified_base (393)..(393): a, c, t, g, unknown or other
  modified_base (413)..(413): a, c, t, g, unknown or other
  modified_base (435)..(435): a, c, t, g, unknown or other
  modified_base (439)..(439): a, c, t, g, unknown or other
tcagacatacgcgtcacgaccggtgctcgatttagagctcacgtattgggtttggggaggcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggnaggagggtcaccatctcttgttctggaagcgactccaacatcggcgatactcatgtntactggtaccaanaggtccaggaccgaccccaaactccncatgtactgacagtagtgagcgcctcgaggggtaccctgaccgtattctcgtggctctaaggtctcggcaccgtcgcctacccgngacncncacgcgccgtcgacgagagngacgctagtattacgtactgtncagnagtaggtaactacgacgtgagtacgtagtacgttaggttcgggttcggtcgggacgggacggaccgacggtcgtaccgtaccggtaacgtacggacgaccgaccgacggtccgtacccgccccg

SEQ ID NO: 404199 - DNA, 499 bp, Homo sapiens
  misc_feature: GZ8MTXP02FQAFJ.22.28.C06.1.454.CMB.2.raw
  modified_base (433)..(433): a, c, t, g, unknown or other
  modified_base (491)..(499): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctgttgggtgttcggcggagggaccaggctgaccgtcctaggtcagcccaaggctgccccctcggtcnctctcgttcccaccctcctcacgcgtatgtctgagcgggctggcaagggcgcagtagnnnnnnnnn

SEQ ID NO: 404200 - DNA, 503 bp, Homo sapiens
  misc_feature: GZ8MTXP02JFZHC.22.28.C06.1.454.CMB.2.raw
  modified_base (494)..(503): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatctgttgggtgttcggcggagggaccagggctgaccgtcctaggtcagcccaagctcgccccctcggtcactctcgttccccgccctcctcacgcgtatcgtctgagcgggctggcaacggcgcatagnnnnnnnnnn

SEQ ID NO: 404201 - DNA, 740 bp, Homo sapiens
  misc_feature: GZ8MTXP02II5BX.22.28.C06.1.454.CMB.2.raw
  modified_base (208)..(208): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtcgtcggggacccccggnagagggtcaccatctcttgttctggaagcgactccaaacatcggcgatactcatgtgtactggtaccaacacggtcccgagggaccgacccccaaactcctcatgtatgacagtagtgacgccggccctcgacggggtccctagaccgtattcctcgtggcctactaagttctcgggcctacccgttcccgggcccccttcccccgtgggaaccctacgtaccgacggtccgggtccccgttacccggggtcccggaaggggtattcgggacgggtcttaggtaatttaacttacgttcggttgaccgtaaggtccgtaaggttacggggtaaactttaaaccgaaacccgttggtaacggttagtaacgttcccgtttaaggggttttcgggggttcgggtttaccgggggacgggggtaaacggggaacccgtacggggtacccgtttacggaaccccggtttaaccggtacggggttaccgaaccgggaacccccgtaaacggggtcccgtttacccggtcccccccgg

SEQ ID NO: 404202 - DNA, 576 bp, Homo sapiens
  misc_feature: GZ8MTXP02HN2ZL.22.28.C06.1.454.CMB.2.raw
  modified_base (338)..(338): a, c, t, g, unknown or other
  modified_base (353)..(353): a, c, t, g, unknown or other
  modified_base (383)..(383): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgccaacccctccctcagggctcgagtcagcctgtcagtagacacgtccaagaaccagacttcccngagactgacccctcngtcgaccgcgcagcacgggcctgtatttcngtgtcggtacgagtgtccatgacagtcaacaaacactaggtctccgtggggccagggtaaccctggtccacgtcctccgtcacgccctccaccgaacgggcccctaacgtcccggttcccttcccccgtcggccctaccccgtccttcccgaaacgcgaccaccgttccgcgggggaccacgacggccccggg

SEQ ID NO: 404203 - DNA, 493 bp, Homo sapiens
  misc_feature: GZ8MTXP02I7BJX.22.28.C06.1.454.CMB.2.raw
  modified_base (362)..(362): a, c, t, g, unknown or other
  modified_base (489)..(493): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatggattacaacctgagtnagtcctgttgggtgttcggcggagggaccagggctgacgtcctaggtcagcccaggctgccccctcggtcactctcgttcccaccctcctcacgccgtatgtctgagcggctggcaaggcgcatagnnnnn

SEQ ID NO: 404204 - DNA, 500 bp, Homo sapiens
  misc_feature: GZ8MTXP02HGA5J.22.28.C06.1.454.CMB.2.raw
  modified_base (490)..(500): a, c, t, g, unknown or other
tcagacatacgcgtcacgaccggtgctcgatttagagctcacgtattgggtttgggggccgtccctgggcccagtctgtgttgactcagccaccctccagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctcggtccgaggatgaggctgattattactgtgcagcatgggattacaacctgatgatctgttgggtgttcggcggagggaccaggctaaaccgtcctaggtcagcccaagctcgccccctcggcactctcgttcccaccctcctcacgcgtatcgtctgagcggctgggcaaggcgcatagnnnnnnnnnnn

SEQ ID NO: 404205 - DNA, 657 bp, Homo sapiens
  misc_feature: GZ8MTXP02GHRQT.22.28.C06.1.454.CMB.2.raw
  modified_base (403)..(403): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtgctccatcagtgattactactggacctggactccggcacgtccccagggcagggactggaatggattggatatttccatacgactgcgatgaccaactcgaccaacccctcctcgacgggtcctcgacgtcagcctgtcagtagacacgtaccaaagaccagaccttccagacgactcgaccctcgtgtcgaccgccacgacgccgacggtccgttgttactttcgngtcggtcgggtacgtaggttcgtcctagtcgaactagtaccaaacgaaaactaacgtcggtccttaccggtcggggacccgacggggtaacccgtcgggtacccgtacccgtcctaccgtacgaccgtccctacccgaccgaaccgggtcccctacgttcccgggttcccttcccccggtcggcccctaccccgtaccctaccaaacggaaccgcccacccggtcggtaccgggggaccacggacggccccggg

SEQ ID NO: 404206 - DNA, 628 bp, Homo sapiens
  misc_feature: GZ8MTXP02G44ZB.22.28.C06.1.454.CMB.2.raw
  modified_base (207)..(207): a, c, t, g, unknown or other
  modified_base (244)..(244): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggaccccggnagagggtcaccatctcttgttctggagcgactccaanagtcggcgatactcatgtgtactcggtaccaacgacggtcccgacggggaccccgacccccaaactcctcatgtatgacagtagtgacgccggtaccctcggacggggtccctgtaccgtcttctcgtggtctacgtaacgtcgtcggcctaccggtccggtccctccgtacggacacgtcgtacgtcggcccgtcggtccgaggtatcggagtctagtacttattacgtgtacgtcagactagtacggtaacttaacgacgtagtagtacgtacgttcgttagggtttcgggtcgggttcgggacgggacgggtaccgagggtccgtacggtaccggtccgtaacggtccgacggacccgaacggtccctcccggtcccccgg

SEQ ID NO: 404207 - DNA, 510 bp, Homo sapiens
  misc_feature: GZ8MTXP02JPPJO.22.28.C06.1.454.CMB.2.raw
  modified_base (377)..(377): a, c, t, g, unknown or other
  modified_base (384)..(384): a, c, t, g, unknown or other
  modified_base (481)..(481): a, c, t, g, unknown or other
  modified_base (494)..(494): a, c, t, g, unknown or other
  modified_base (498)..(510): a, c, t, g, unknown or other
tcagacatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctgagggggtcccctgaccgattctctggctctaagtctggcacctcggcctccctggacatcagtggccctccggtccgaggatgaggctgattattactgtgcagcatgggattacaactgatgatctgtgggtnttcgggnggagggaccaggctgaccgtcctaggcagcccaaggctcgccccctggccactctgttccccgcctcctcacgccgtatcgtctggacgcggggcgngacgacggcgcanagannnnnnnnnnnnn

SEQ ID NO: 404208 - DNA, 511 bp, Homo sapiens
  misc_feature: GZ8MTXP02IPRJA.22.28.C06.1.454.CMB.2.raw
  modified_base (358)..(358): a, c, t, g, unknown or other
  modified_base (500)..(511): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctcctggacatcagtggcctccggtccgaggatgaggctgattattactgtgcagcatgggacttaaaaccngagtgatccgttagttggggtgttcgggcgggagggaccgagggctgaccgtcctggtcagcccaaggctcgcccctcggtcactctcgttccccaccctccctcacgcgtatcgtctgaggcgggctggcaaggcgcatgnnnnnnnnnnnn

SEQ ID NO: 404209 - DNA, 588 bp, Homo sapiens
  misc_feature: GZ8MTXP02HQVWA.22.28.C06.1.454.CMB.2.raw
  modified_base (206)..(206): a, c, t, g, unknown or other
  modified_base (242)..(242): a, c, t, g, unknown or other
  modified_base (389)..(389): a, c, t, g, unknown or other
  modified_base (473)..(473): a, c, t, g, unknown or other
tcagacatacgcgtcacgaccggtgctcgatttagagctcacgtattggggtttggggaggcttcagctgtggtagagaagacaggattcaggacaatctccagcatggccggcttccctctcctcctcaccctcctcactcactgtgcagggtcctgggcccagtctgtgttgactcagccacctcagcgtctgggacccccggnaggagggtcacatctcttgtctggagcgactccaanatcggcatactcatgtgtactgtaccaacgacggtcccaaggggaccggccccccaaactcctcatgtatgaacagtagtgagcggcctcgaggggtccctgaccgtatctcgtgcctctaacgctcggcaccgtcggaccctccgnggacatcagtcggcctaccgggtccgaggactggacgctgattaagttccgtgtagctagctaggtggaactacgacgtgagtnaacgttccgttaaggttcgggttggtttcggggacgggtaacggggaccgtacggaccgttcgacccggttcgacgggttcaccggaccgaaccgggtctacccggtccccccgg

SEQ ID NO: 404210 - DNA, 645 bp, Homo sapiens
  misc_feature: GZ8MTXP02IQRQR.22.28.C06.1.454.CMB.2.raw
  modified_base (580)..(580): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcacgtccccagggcagggactggaatggattggatattcatacgactgcgatgaccaactcgaccaaccccctccctcgagggcctcgagtcagcctgtcagtagaccacgtaccaaagaaccagaccttcccgagagactcgacccctctgtcgaccgcgacacgaccgacgggtccgttagttacttttcgtggtcggtccgggtacgtagttcgtaccagttcgacgagttaccaaacaaaacctaacgttcggtcctccggtacggggaccaacggggtaaccctgggtacccaacccgttcctcccgtactacgccctacccgaaccgaacgggcccctacgtcccgggttcccttcccccgnggtaccctaccccctaccctacccaacgcgcccaccgttcggacggggccacgacggtccccggg

SEQ ID NO: 404211 - DNA, 707 bp, Homo sapiens
  misc_feature: GZ8MTXP02HAJ1W.22.28.C06.1.454.CMB.2.raw
  modified_base (339)..(339): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgccaacccctcctcacggctcgagtcagcctgtcagtagacacgtccaagaaccagtaccttcccngacgactgacccccttcgtcgtcgacccgccgacgacggaccgacgggtccgttaggttactttccgtaggtttcggtacgggttacgagttcgtccaagtcggaactacgtaccaaactaaaaccgtaacttcggggttaccttacccgggtacgggggaccccgtaacgggggtaaacccccttggggtacccctaacccggttccctacccgttaccgaaccggtcccccttaccccgaacccgtaaaaccggggccccctaacgttccccggggtcccctttcccccggtcggaccccctaccccgtccctaccgaaacgcggccctaacccgtcggtacgggggaccaccgacggtccccggg

SEQ ID NO: 404212 - DNA, 497 bp, Homo sapiens
  misc_feature: GZ8MTXP02GUMZ9.22.28.C06.1.454.CMB.2.raw
  modified_base (382)..(382): a, c, t, g, unknown or other
  modified_base (475)..(475): a, c, t, g, unknown or other
  modified_base (491)..(497): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctcggtccgaggatgaggctgattattactgtgcagcatggacttacaacctgagtgatcctgttgggtgttcgggnggaggggaccagggctgaccgtctaggtcagcccaaggcctcgccccctggtcactctcgttcccaccctcctcacgcgtatgtctgagcggntggcaaggcgcatagnnnnnnn

SEQ ID NO: 404213 - DNA, 583 bp, Homo sapiens
  misc_feature: GZ8MTXP02HV2N4.22.28.C06.1.454.CMB.2.raw
  modified_base (342)..(342): a, c, t, g, unknown or other
  modified_base (358)..(358): a, c, t, g, unknown or other
  modified_base (400)..(400): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcacgtccccagggcagggactggaatggattggatatttccatacgactgcgatgaccaactgccaaacccctccctcagggcctcgagtcagcctgtcagtagacacgtccaaagaccagaccttcccngacgactcgacccctntcgtcgacccgccgcacgccgacgggccgttgttacttttcnggttgtcggtacgtgtcgtccatgacagtacaacaaacaactcgtctcgtcggggaccacggggtaccctggtccaccgtctcctcacgcctaccaccgaacgggccctacgtccggttcccttcccccgtcggcccaccctcctaccgacgaacgccaccgtcgcggggccacgacgcccgg

SEQ ID NO: 404214 - DNA, 589 bp, Homo sapiens
  misc_feature: GZ8MTXP02JBLI4.22.28.C06.1.454.CMB.2.raw
  modified_base (206)..(206): a, c, t, g, unknown or other
  modified_base (510)..(510): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccactctcagcgtctgggaccccccggnagagggtcaccatctcttgttctggaagcgactccaacatcggcgatactcatgtgtactggtaccaacaggtccccagggaccgcccccaaactcctcatgtatgacagtagtgagccggccctcgacggggtccctgaccccgtattctctggctcgtaagtctggcacctcggccctcccgtggaccatcgagtcggcctccggtccgaggatgagctagatttatactgtcgcagctagtggggtaattacgaacctggtaagtcgtaattccgttaggtttggggttcggttacggggnggggtaacgggaccgtacgggtcgtacggaacccgttaccgtacgggtaccgacggacccgtaacggccgttcccccgg

SEQ ID NO: 404215 - DNA, 498 bp, Homo sapiens
  misc_feature: GZ8MTXP02FY4N6.22.28.C06.1.454.CMB.2.raw
  modified_base (338)..(338): a, c, t, g, unknown or other
  modified_base (378)..(378): a, c, t, g, unknown or other
  modified_base (484)..(484): a, c, t, g, unknown or other
  modified_base (487)..(498): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcgacggggtccctgaccgattctctggctctaagtctggcacctcggcctccctggacatcagtggcctccggtccgaggatgaggctgattatacngtgcagcatggatacactgagtgatctgtggtgtcggcgngggacaggctgacgtccgtagtcacgcccgaaggctcgcccctcggtcactctcgtcccaccctcctcacgtctagtcgtctgagcggcgtggcgaacggcgacanagnnnnnnnnnnnn

SEQ ID NO: 404216 - DNA, 539 bp, Homo sapiens
  misc_feature: GZ8MTXP02HWXQE.22.28.C06.1.454.CMB.2.raw
  modified_base (528)..(539): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaatcctcatgtatgacagtagtgagcggccctcgaggggtccctgaccgattctctggctctaagtctggcacctcggcctcctggacatcagtcggcctccggtccgaggatggaggctgattattactgtgcagcagtggacttacaacctgagtgacttcgtggtttggggtgttcggggccgggtaggggacccagggtcctgacccgtccgttaggtcacggcccgaaggcctcgccccctcggtcactcttccgttcccctacccttcctccacgccgtagtcgtctgacgcgggctggacgacggcgcatagcnnnnnnnnnnnn

SEQ ID NO: 404217 - DNA, 580 bp, Homo sapiens
  misc_feature: GZ8MTXP02FW6E0.22.28.C06.1.454.CMB.2.raw
  modified_base (293)..(293): a, c, t, g, unknown or other
  modified_base (339)..(339): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgccaacccctcctcagggcncgagtcagcctgtcagtagaccacgtaccaagaaccagacttcccngagactgacccctctgtgaccgcgcagcgacgccgtagtactttctgtgtcggtagagtgtccatgacagcaacaaacaactcgtctaccgtcggggaccaacgggtacccgtcggtccgaccgtcctccctacacgccctccaccgaacgggcccacgtccggtcccttcccccgtcgaccctacccctcctacccaacgaacgcccaaccgtccggtacgggggaccacgacggcccgg

SEQ ID NO: 404218 - DNA, 509 bp, Homo sapiens
  misc_feature: GZ8MTXP02GQ82K.22.28.C06.1.454.CMB.2.raw
  modified_base (500)..(509): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctcaggggtccctgaccgattctctggctctaagtctggcacctcggcctccctggacatcagtggcctccggtccgaggatgaggctgattatactgtgcagcatgggattacaacctgagtgatctggttgggtgttcggcggaggggaccagggctgaccgtccgtaggtcagcccaggcctcgccccctcggtccactctcgttcccaccctcctccacgctatcgtctgacgcgggctcgggcaacggcggcagtagnnnnnnnnnn

SEQ ID NO: 404219 - DNA, 562 bp, Homo sapiens
  misc_feature: GZ8MTXP02JICJZ.22.28.C06.1.454.CMB.2.raw
  modified_base (205)..(205): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggnagagggtcaccatctcttgttctggaagcgactccaacatcggcgatactcatgtgtactggtaccaacaggtccccagggaccggcccccaaactcctcatgtatgacagtagtgagcggccctcgacggggtcccctgaccgtattctcgtggctctaagtctggcctaccgtcggccctccgtggaccatccgagtcggcccgtccgggtcgaggatggaggctgtattattacgtgtgcagcagtaggtacttacacgtgagtgtatccgtaggttcgggtagttcgggacggtagggaccgacggtcgtacgaccgtcgtacggtccacgcccgaacggccgtcgtcccccg

SEQ ID NO: 404220 - DNA, 546 bp, Homo sapiens
  misc_feature: GZ8MTXP02GCWFI.22.28.C06.1.454.CMB.2.raw
  modified_base (363)..(363): a, c, t, g, unknown or other
  modified_base (407)..(407): a, c, t, g, unknown or other
  modified_base (448)..(448): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaacatcggcgatactcatgtgtactggtaccaacgacggtccccaggggacccggaccccccaaactcctcatcgtatgacagtagtgagccggccctcgacggggtccctgaccgtattccncgtggtcctcgtaagtctggccacctcgggccctcccgtgactntcgagtcggcctcggtcgagtactgagctgattatactgtnctgcagtggacttacgactgagtgatcgtaggtcgggtgtcgggcggaggaccgaggcgtcgaccgtcgtaggtcacgcccgaggccgtcgtcccccg

SEQ ID NO: 404221 - DNA, 721 bp, Homo sapiens
  misc_feature: GZ8MTXP02F8PV9.22.28.C06.1.454.CMB.2.raw
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcacgtccccagggcagggactggaatggattggatatttccatacgactgcgatgaccaactcgaccaacccctccctcgacgggcctacgagtcagcctgtcagtacgaccacgtaccaaaagaacccagtaccttccctagacgtacctcggacccctcgtcggtacgaccccgccgacgacgccgtaccgggccgttgttactttccgtggtcgtaccgggtacgtagttcgtaccgtagtcgaactacgtaccaaacaaaactaacgtcggtcctcggtacggggacccgtacggggtaacccgtcgggtacctacccgtcctcccgtacgaccggtacccctacccgaacccggaaaaccggggtccccctaacggtttccccgggttccccctttccccccggtaccggtcccccgtaacccccttacccgacccgtaaacgaacccgtacccgtaacccgtccggggtaccgggggacctaaccggaccgggtcccccgggg

SEQ ID NO: 404222 - DNA, 486 bp, Homo sapiens
  misc_feature: GZ8MTXP02I7FO3.22.28.C06.1.454.CMB.2.raw
  modified_base (479)..(486): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcaacacggcctcctgaccgtctctgggctccaggctgaggatgaggctgattatactgcagctcatatggagcagcgacaatttggtgttcggcggagggaccaagctgaccgtctaggtcacgcccaaggctcgccccctggtccactctcgttccccgccctcctcaccgcgtatgtctgagcggctggcaggcgcatagnnnnnnnn

SEQ ID NO: 404223 - DNA, 537 bp, Homo sapiens
  misc_feature: GZ8MTXP02JAZJZ.22.28.C06.1.454.CMB.2.raw
  modified_base (524)..(524): a, c, t, g, unknown or other
  modified_base (526)..(537): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggcccccaaactcctcatgtatgacagtagtgagcggccctcgaggggtccctgaccgattctctggctctaagtctggcacctcggcctccctggacatcagtggcctccggtccgaggatgaggctgattattactgtgcagcagtgggattacactgacgtgattcctaggttgggtgttcgggcgggtagggacgagggtctgacccgttcctaggtcagcccaaggcctcgccccctcggccactctcgttccccacccgtcctccacgcgtactcgtctggacggcggggtctcgggcgaacgggcgacaacgtgcncnnnnnnnnnnnn

SEQ ID NO: 404224 - DNA, 545 bp, Homo sapiens
  misc_feature: GZ8MTXP02GU8CA.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaacatcggcgatactcatgtgtactggtaccaacacggtcccaggggaccggccccccaaactcctcatgtatgacagtagtgagccggccctcgacggggtcccctggaccgtattcctctggctcgtaagtctggccaccgtcggccctccctggacatcaggtcggcccgtccggtccgaggtatggacggctgtattattacgtgtgcagctagtgggattacgactgagtgatcgtaggttgggtgttcgggcggaggcgaggctgaccgtcgtaggcgacgaccgacggctcgtccccg

SEQ ID NO: 404225 - DNA, 549 bp, Homo sapiens
  misc_feature: GZ8MTXP02HTYKH.22.28.C06.1.454.CMB.2.raw
  modified_base (309)..(309): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcggggaccccccgggcaggagggtcaccatctcttgttctggaagcgactccaacatcggcgatactcatgtgtactggtaccaacaggtcccagggaccggacccccaaactccncatgtatgacagtagtgagccggccctgacggggtccctgaccgtacttctctggctctaagtctggccaccgtcggccctcccgtggacatcagtcggcctccggtccgagtagtgaggctgtattattactgtgcagcagtggattacacgtgagtagatcgtaggttggtcggttcggacggagggaccgaggcgtcgaccgtcgtaggtcgacgacccgacggtcctcgtcccccg

SEQ ID NO: 404226 - DNA, 557 bp, Homo sapiens
  misc_feature: GZ8MTXP02IY3VG.22.28.C06.1.454.CMB.2.raw
  modified_base (342)..(342): a, c, t, g, unknown or other
  modified_base (440)..(440): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaacatcggcgatactcatgtgtactggtaccaacacggtcccagggaccgcccccaaatcctcatgtatgacagtagtgagcggccctcgacggggtccccngaccgattcctctggctctaagtctggccacctcggccctccctggacatcgagtcggccgtccggtcccgaggatgaggctgtattacgttactgtncgtagctagtggacttacaacctgaagtgaagtccgtaggttggggtgttcggggcgggagggaccgacggccgtcgaccgtcgtacggtcgacgcccgaacggcctcggtcccccg

SEQ ID NO: 404227 - DNA, 583 bp, Homo sapiens
  misc_feature: GZ8MTXP02IPS17.22.28.C06.1.454.CMB.2.raw
  modified_base (323)..(323): a, c, t, g, unknown or other
  modified_base (570)..(583): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagccggccctcgaggggtccctgaccgattctctggctctaagtctggcacctcggcctccctggacatcagtggccctccggtccgaggntgaggctgattatttactgtgcagcagtgggtattacaacctgagtgacttccgtggttgggtgttcgggcgggagggaccagggctggacccgtccgtaggtcaggtaccccgaaggccgtccgccccccgtccgggtaccaaccgttccgttcccggttcccccgtcccccgttcccgtccgtacccggtccgttactcggtactggacggtccggggcgtcgggacgaacgggcgactacgagnnnnnnnnnnnnnn

SEQ ID NO: 404228 - DNA, 508 bp, Homo sapiens
  misc_feature: GZ8MTXP02IJ4XI.22.28.C06.1.454.CMB.2.raw
  modified_base (241)..(241): a, c, t, g, unknown or other
  modified_base (314)..(314): a, c, t, g, unknown or other
  modified_base (479)..(479): a, c, t, g, unknown or other
  modified_base (496)..(508): a, c, t, g, unknown or other
tcagacatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagcggccctnaggggtccctgaccgattctctggctctaagtctggcacctcggcctcctggacatcagtgcctccggtccgnggatgaggctgattattactgtgcagcatggattacacctgagtgattcctgggttgggtgttcggggcgaggggcagggctgccgtcctaggtcacgcccgaaggcctcgcccccgtcggtcactctcgttccccacccctcctcacgctatgtctgaggcggntggcaacggcgcatagnnnnnnnnnnnnn

SEQ ID NO: 404229 - DNA, 511 bp, Homo sapiens
  misc_feature: GZ8MTXP02GNVYT.22.28.C06.1.454.CMB.2.raw
  modified_base (241)..(241): a, c, t, g, unknown or other
  modified_base (457)..(457): a, c, t, g, unknown or other
  modified_base (500)..(511): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctnaggggtccctgaccgattctctggctctaagtctggcacctcggcctccctggacatcagtggccctcggtccgaggatgaggctgattattactgtgcagcatgggacttacaacctgatgatctggttgggtgttcgggcggagggaccaggctgacccgtctagtcacgcccgaaggcctcgccccctcggtcactctcgttcccgccctccncacgcgtactcgtctgagtcgggctgggacacggcgctagagnnnnnnnnnnnn

SEQ ID NO: 404230 - DNA, 557 bp, Homo sapiens
  misc_feature: GZ8MTXP02GZUWU.22.28.C06.1.454.CMB.2.raw
  modified_base (347)..(347): a, c, t, g, unknown or other
  modified_base (396)..(396): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccgggcaggagggtcaccatctcttgttctggaagcgactccaacatcggcatactcatgtgtactggtaccaacgacggtccccaggggaccgacccccaaactcctcatgtatgacagtagtgagcggcctcgacggggtcccngaccattctctggctcgtaagtctggccaccgtccggcctccgtggacntcgagtcggccgtccggtcgaggagtgacgctagtattatacgtgtgcagcagtggactacaacgtgagtgactcgtaggttcgggtggttcgggcgggtacgggaccgacggcgtcggaccgtcgtacggtcgacgtcccgaacggtcctccgtcccccg

SEQ ID NO: 404231 - DNA, 549 bp, Homo sapiens
  misc_feature: GZ8MTXP02IV2LG.22.28.C06.1.454.CMB.2.raw
  modified_base (207)..(207): a, c, t, g, unknown or other
  modified_base (499)..(499): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcacccctcctcactcactgtgcagggtcctgggcccagtctgtgttgactcagcccaccctcagcgtctgggacccccggnagagggtcaccatctcttgttctggaagcgactcccaaacatcggcgatactcatgtgtactggtaccaacaggtcccagggaccggcccccaaactcctcatgtatgacagtagtgagccggcctcgaggggtccctgaccgtattctctggcttctaagtctggccacctccggccctcccgtggacatcgagtcggccctccgggtccgaggatggagctagattattactgtgcagcagtggattacactgacgtgatcgtaggttgggtgttcgggcggagggaccngggctcggacccgtccgtaggtcacgacccgaacggccgtccgtcccccg

SEQ ID NO: 404232 - DNA, 527 bp, Homo sapiens
  misc_feature: GZ8MTXP02IQF68.22.28.C06.1.454.CMB.2.raw
  modified_base (515)..(527): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagcggccctgaggggtccctgaccgattctctggctctaagtctggcacctcggcctccctggacatcagtggccctccggtccgaggatgaggctgattattactgtgcagcatgggattacactgagtgatctggttgggtgttcgggcgaggggaccagggctcgaccgtcctaggtcacgcccgaaggccgtacgcccccgtcgggtccacgtcctcgttccccgccctccctccacgccgtactcgtctgacggcggcgtggcgaacggcgacagtgnnnnnnnnnnnnn

SEQ ID NO: 404233 - DNA, 551 bp, Homo sapiens
  misc_feature: GZ8MTXP02H058D.22.28.C06.1.454.CMB.2.raw
  modified_base (244)..(244): a, c, t, g, unknown or other
  modified_base (262)..(262): a, c, t, g, unknown or other
  modified_base (346)..(346): a, c, t, g, unknown or other
  modified_base (448)..(448): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaanatcggctatactcatgtntactggtaccaacaggtcccagggaccggccccccaaactccctcatgtatgacagtagtgagccggccctcgacggggtcccngaccgattctctggctctaagtctggccacctccggccctcccgtgactactcaggtcggcccttccgggccgaggtatggaggtctgtatttattactgtnctagcagtggattacaactgagtgatcgtagttgggtgttcgggcgtagggaccagggctcggaccgtccgtaggtcacggaccccgaaggcctcgccccccg

SEQ ID NO: 404234 - DNA, 566 bp, Homo sapiens
  misc_feature: GZ8MTXP02IKGGP.22.28.C06.1.454.CMB.2.raw
  modified_base (368)..(368): a, c, t, g, unknown or other
  modified_base (533)..(533): a, c, t, g, unknown or other
  modified_base (554)..(566): a, c, t, g, unknown or other
tcagacatacgcgtcacgaccggtgctcgatttagagctcacgtattgggttttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgccccccaaactcctcatgtatgacagtagtgagcggccctcgaggggtccctgaccgattctctggctctaagtctggcacctcggcctccctggacatcagtggcctccggtccgaggatgaggctgaattattactgtgcagcagtggacttacaactgagtnattctgttgggtgttcggacgggagggaccaggctacgaccgtcctagggtcacgaccccgaaggccctaccgtcccccgtcgggtaccaccgttccttccggtttcccccaacccccttcccgtaccaccggtccgttacgtcgtccgtgggacggcgggtcgngggacgaacggcgacatagcnnnnnnnnnnnnn

SEQ ID NO: 404235 - DNA, 551 bp, Homo sapiens
  misc_feature: GZ8MTXP02GOXFT.22.28.C06.1.454.CMB.2.raw
  modified_base (470)..(470): a, c, t, g, unknown or other
  modified_base (540)..(551): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacgcccccaaactcctcatgtatgacagtagtgagcggccctcgaggggtccctgaccgattctctggctctaagtctggcacctcggcctccctggacatcagtggcctccggtccgaggatgaggctgattattactgtgcagcagtgggattacactgagtgatctggttgggtgttcgggcggagggacaggcgtcgaccgtccgtaggtcgacgcccgaaggcctcgcccccgtcgggtccactccttccgttccccgccccttccnccacgtccgtacgtcgtcgtcgacggccggggtcgtcgggacgtaacgggcccgccgaaagtcggcgcgnnnnnnnnnnnn

SEQ ID NO: 404236 - DNA, 543 bp, Homo sapiens
  misc_feature: GZ8MTXP02H6JAB.22.28.C06.1.454.CMB.2.raw
  modified_base (533)..(543): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccaggggaccggcccccaaactcctcatgtatgacagtagtgagcggccctcgaggggtccctgaccgattctctggctctaagtctggcacctcggcctccctggacatcagtggcccctccggtccgaggatggaggctgaattattactgtgcagcatgggacttacaacctgagtgattcctggttggggtgttcgggcgtagggacaggcctgaccgtctaggtcacgcccgaagtcctcgcccccctacggtccactcgtcgttcccccgcccttcctccacggtcgtagtcgtcgtggacggccggggctgggaccgaacggcggactagagcnnnnnnnnnnn

SEQ ID NO: 404237 - DNA, 499 bp, Homo sapiens
  misc_feature: GZ8MTXP02JDLD5.22.28.C06.1.454.CMB.2.raw
  modified_base (453)..(453): a, c, t, g, unknown or other
  modified_base (468)..(468): a, c, t, g, unknown or other
  modified_base (473)..(473): a, c, t, g, unknown or other
  modified_base (484)..(484): a, c, t, g, unknown or other
  modified_base (490)..(499): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaatcctcatgtatgacagtagtgagcggccctcgaggggtccctgaccgattctctggctctaagtctggccacctcggcctccctggacatcagtggccctccggtccgaggatggaggctgattatactgtgcagctagtggacttacaacctgagtgatctggttggtgttcggcggaggacaggctcgaccgtcagtcacgcccgagcctcgcccctcggcacttctcgttcccaccctccncacgcgtatgtctgngcggntcggcgaggcncaagtnnnnnnnnnn

SEQ ID NO: 404238 - DNA, 523 bp, Homo sapiens
  misc_feature: GZ8MTXP02GEQ2B.22.28.C06.1.454.CMB.2.raw
  modified_base (365)..(365): a, c, t, g, unknown or other
  modified_base (385)..(385): a, c, t, g, unknown or other
  modified_base (467)..(467): a, c, t, g, unknown or other
  modified_base (511)..(523): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgcccccaaactcctcatgtatgacagtagtgagcggccctcgaggggtccctgaccgattctctggctctaagtctggcacctcggcctcctggacatcagtcggcctccggtccgaggatgaggctgattattactgtgcagcagtgggacttacactgagtnatctggttgggtgttcgggnggtagggacagggctcgaccgtccgtaggtcacgcccgaaggcctcggccccctcggtcacctctccgttcccgcccctccncacgcgtactcgtcgtgaggcgggcgtggacgaaggcgcagtgnnnnnnnnnnnnn

SEQ ID NO: 404239 - DNA, 617 bp, Homo sapiens
  misc_feature: GZ8MTXP02H7CI1.22.28.C06.1.454.CMB.2.raw
  modified_base (207)..(207): a, c, t, g, unknown or other
  modified_base (247)..(247): a, c, t, g, unknown or other
  modified_base (312)..(312): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtcgtcgggacccccggnaggacgggtcaccatctcttgttctggaagcgactccaanagtcggcgatactcatgtgtactggtaaccaacacggtcccagggacccggacccccaaactccncatgtatgaacagtagtgagccggcctcgacggggtccctggaccgacttctctcggctacgtaagtctcggacctaccgtccggccctcccgtggaccacgtccaggtcggccctcccgggtccgagggtagtcggacggtctaggatttactacgtgttgcagcgagtgggattaccgaaccgtgtagtcgtaacttccgttaagggtttcgggtacgggttccgggacggggtacgggaccgacgggccgtacggacccggtccgtacggccgacgcccgaaacggccgtacccgcccccgg

SEQ ID NO: 404240 - DNA, 520 bp, Homo sapiens
  misc_feature: GZ8MTXP02FPD2Z.22.28.C06.1.454.CMB.2.raw
  modified_base (507)..(507): a, c, t, g, unknown or other
  modified_base (509)..(520): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcaggggtcccctgaccgattctctggctctaagtctggcacctcggcctccctggacatcagtggcctccggtccgaggatgaggctgattattactgtgcagcagtggattacaacctgagtgatcctaggttggggtgttcggcggtagggaccagggctgaccgtcctaggtcagcccaggctcgccccctcggcactctcgtcccaccctcctcacgcgtatcgtcgtgacggcggctcgggacgaacgggcgacgtacagncnnnnnnnnnnnn

SEQ ID NO: 404241 - DNA, 498 bp, Homo sapiens
  misc_feature: GZ8MTXP02FQIUI.22.28.C06.1.454.CMB.2.raw
  modified_base (471)..(471): a, c, t, g, unknown or other
  modified_base (492)..(498): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggccccccaaactcctcatgtatgacagtagtgagcggccctcaggggtccctgaccgattctctggctctaagtctggcacctcggcctcctggacatcagtggcctccggtccgaggatgaggctgattattactgtgcagcatgggattacaacctgagtgatcctgttgggtgttcggcggagggaccagggctgaccgtcctaggtcagcccaaggctcgccccctcggtcactctcgttcccgccctcctcacgcgtatgtctgngcggctggcacggcgcatagnnnnnnn

SEQ ID NO: 404242 - DNA, 508 bp, Homo sapiens
  misc_feature: GZ8MTXP02HPOJ9.22.28.C06.1.454.CMB.2.raw
  modified_base (321)..(321): a, c, t, g, unknown or other
  modified_base (461)..(461): a, c, t, g, unknown or other
  modified_base (477)..(477): a, c, t, g, unknown or other
  modified_base (499)..(508): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggcccccaaactcctcatgtatgacagtagtgagcggccctcgaggggtccctgaccgattctctggctctaagtctggcacctcggcctcctggacatcagtggcctccggtccgaggntgaggctgattattactgtgcagcagtgggattacacctgagtgacttctgttgggtgttcggcgggagggaccgagctgaccgtccgtaggtcagcccgaggcctcgccccctcggtcactctcgttcccacccttccncaccgctatcgtctgngcggctggcgacggcgcatagnnnnnnnnnn

SEQ ID NO: 404243 - DNA, 526 bp, Homo sapiens
  misc_feature: GZ8MTXP02F0939.22.28.C06.1.454.CMB.2.raw
  modified_base (206)..(206): a, c, t, g, unknown or other
  modified_base (425)..(425): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggnagagggtcaccatctcttgttctggaagcgactccaacatcggcgatactcatgtgtactggtaccaacaggtcccagggaccgcccccaaactcctcatgtatgacagtagtgagccggccctcgacggggtccctgaccgattctctggctctaagtctggccaccgtcggccctccctggacatcagtcggcctccggtcgagatgaggctgattnttactgtgcagcagtggtactacaactggagtgatcgtagttgggtgttcggcggaggaccaggctgacccgtctaggccacgcccaggcctcgtcccccg

SEQ ID NO: 404244 - DNA, 540 bp, Homo sapiens
  misc_feature: GZ8MTXP02JA39G.22.28.C06.1.454.CMB.2.raw
  modified_base (521)..(521): a, c, t, g, unknown or other
  modified_base (529)..(540): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgcccccaaactcctcatgtatgacagtagtgagccggccctcgaggggtcccctgaccgtattctctggctctaagtctggcacctcggcctccctggaccatcagtggccctccggtccgaggatgaggctgattattactgtgcagcagtggacttacacctgagtgacttctggttgggtgttcggcggagggaccaggcgtgacccgtccgtaggtcgacgcccgaaggcctccgcccccgtcggtccaccgtctccgttccccgccctcctccaccgtctacgtgtcctggacggtccggcgtggacagggccgnacgtagcnnnnnnnnnnnn

SEQ ID NO: 404245 - DNA, 521 bp, Homo sapiens
  misc_feature: GZ8MTXP02IC81I.22.28.C06.1.454.CMB.2.raw
  modified_base (514)..(521): a, c, t, g, unknown or other
tcagacatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggccccccaaactcctcatgtatgacagtagtgagcggccctcgaggggtccctgaccgattctctggctctaagtctggcacctcggcctccctggacatcagtggccctccggtccgaggatgaggctgaattattactgtgcagcagtggattacaactgagtgatcctgtttggggtgtttcggggcggaggggacccagggccgtgacccgtccgtaggtcacgcccgaaggcctcgcccccgtcggtcactcctcgttccccacccttcctcacgccgtatcgtctgcgcggcgtggccaggcgcatgnnnnnnnn

SEQ ID NO: 404246 - DNA, 552 bp, Homo sapiens
  misc_feature: GZ8MTXP02HGNUN.22.28.C06.1.454.CMB.2.raw
  modified_base (242)..(242): a, c, t, g, unknown or other
  modified_base (248)..(248): a, c, t, g, unknown or other
  modified_base (424)..(424): a, c, t, g, unknown or other
  modified_base (428)..(428): a, c, t, g, unknown or other
  modified_base (441)..(441): a, c, t, g, unknown or other
  modified_base (443)..(443): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccggcagaggtcaccatctcttgtctggaagcgactccaanatcggngatactcatgtgtactggtaaccaacgacggtccccaggggacccgtaccccccaaaactccctcaatgtatgacagtagtgagccggccctgacggggtccctgaccgattctcgtggcttactagtctgccaccgtcgccctccgtgacatcagtcgccgtccggccgagtagngagntgtattatagtgnanagctagtagtactaacacgtgagtgtactacgtggttcggtcggttcggacgggacggacgacgtcgtacgaccgtcgtacgaccgacgaccgacgtccgtccgccccg

SEQ ID NO: 404247 - DNA, 506 bp, Homo sapiens
  misc_feature: GZ8MTXP02I1JVS.22.28.C06.1.454.CMB.2.raw
  modified_base (242)..(242): a, c, t, g, unknown or other
  modified_base (494)..(506): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctnaggggtcccctgaccgattctctggctctaagtctggcacctcggcctccctggacatcagtgccctcggtccgaggatgaggctgattattactgtgcagcatgggattacaaactgagtgatcctgttgggtgttcggcggtagggaccagggctgaccgtcctaggtcacgcccgaaggctcgccccctcgcactctcgtcccaccctctcacgcgtatcgtctgagcgggctggcaggcgacgatagnnnnnnnnnnnnn

SEQ ID NO: 404248 - DNA, 551 bp, Homo sapiens
  misc_feature: GZ8MTXP02JCRME.22.28.C06.1.454.CMB.2.raw
  modified_base (538)..(538): a, c, t, g, unknown or other
  modified_base (540)..(551): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagccggccctcgaggggtcccctgaccgattctctggctctaagtctggcacctcggcctccctggaccatccagtcggccctccggtccgaggatgaggctgattatactgtgcagcagtggacttacaaccgtgacgtgactccgtgggttggggtgttcgggcgggagggaccaagtcgtacgccgtccgtaggtcacgcccgaaggcctccgcccccgtcgggtcacttccgtccgttccccacccgttcctcacgtccgtatcgtctggacggtcgggcgtcggcgaacgggcgcaagtgncnnnnnnnnnnnn

SEQ ID NO: 404249 - DNA, 548 bp, Homo sapiens
  misc_feature: GZ8MTXP02IWFAL.22.28.C06.1.454.CMB.2.raw
  modified_base (206)..(206): a, c, t, g, unknown or other
  modified_base (262)..(262): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggnagagggtcaccatctcttgttctggaagcgactccaacatcggcgatactcatgtntactggtaccaacaggtccccagggaccggccccccaaactcctcatgtatgacagtagtgagcggccctcgaggggtccctgaccgtattctctggctctaagtctggccacctccggcccttcccgtggacatcgagtcggccctccgggtccgaggatggaggtctgtattacttacgtgtgcagctagtcggattacaactgaagtgatcgtagttgggtgttcggcggacgggcctagggctcggaccgtcgtaggtcacgcccgtaagcctcgtcccccg

SEQ ID NO: 404250 - DNA, 569 bp, Homo sapiens
  misc_feature: GZ8MTXP02JE1QN.22.28.C06.1.454.CMB.2.raw
  modified_base (243)..(243): a, c, t, g, unknown or other
  modified_base (465)..(465): a, c, t, g, unknown or other
  modified_base (556)..(556): a, c, t, g, unknown or other
  modified_base (558)..(569): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggccccccaaactcctcatgtatgacagtagtgagcggccctnaggggtccctgaccgattctctggctctaagtctggcaccctcggccctcctggacatcaggtcggccctccgggtccgaggactggaggctgtatttattactgtgcagcagtggacttacaactgagtgacttcgtggttgggtcgttcgggcgggagggaccagggcgtcgaccgtccgtaggtcacgcccgaggcccgtccgtcccccgtcggtaccncgttccgtccgttcccccgccccttcctccgaccggtacgtacgtcgttcgtcggacggccgggtcgtgggacgaacgggcgacacgtagncnnnnnnnnnnnn

SEQ ID NO: 404251 - DNA, 547 bp, Homo sapiens
  misc_feature: GZ8MTXP02JHXVG.22.28.C06.1.454.CMB.2.raw
  modified_base (295)..(295): a, c, t, g, unknown or other
  modified_base (367)..(367): a, c, t, g, unknown or other
  modified_base (534)..(534): a, c, t, g, unknown or other
  modified_base (536)..(547): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagccggccctcgaggggtccctgaccgattctctggctctaagtctggcacctcggccctccnggacatcagtcgcctccggtccgaggatggaggctgatttattactgtgcagcagtggacttacactgagtnatctggtttgggtggttcggcggagggcagggctgaccgtcgtaggtcacgcccgaggcctccgcccccgtcggtccacttcctccgtttccccgccccttccctccgaccgtcgtacgtcgtccgtaggcggccggggtcgtcgggcgaacgggcgacagtacggncnnnnnnnnnnnn

SEQ ID NO: 404252 - DNA, 590 bp, Homo sapiens
  misc_feature: GZ8MTXP02GLJDV.22.28.C06.1.454.CMB.2.raw
  modified_base (207)..(207): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtctcgggacccccggnagagggtcaccatctcttgttctggaagcgactccaacatcggcgatactcatgtgtactggtaccaacgaggtccccagggacccggacccccaaactcctcatgtatgacagtagtgagccggccctggacggggtccctggaccgtacttcctcgtggccttacgtaacgtcgtcgggcctacccgtccggcccttcccgtggacatcagtcggcccgtccgggtccgaggatggagctgtattattacgtgtgcagcagtggtaattacgacgtgagtgacttcgtaggttgggtcggttcggggacggacgggaccgacggtccgtacggtacccgtcgtacggtaccgaccgacccgtacgtccgtcccgtcccccg

SEQ ID NO: 404253 - DNA, 588 bp, Homo sapiens
  misc_feature: GZ8MTXP02H2KDX.22.28.C06.1.454.CMB.2.raw
  modified_base (373)..(373): a, c, t, g, unknown or other
  modified_base (575)..(575): a, c, t, g, unknown or other
  modified_base (577)..(579): a, c, t, g, unknown or other
  modified_base (581)..(588): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgccccccaaactcctcatgtatgacagtagtgagccggccctcgacggggtccctgaccgtattctctggctctaagtctggcacctcggcctcctggacatcagtcggccctccgggtccgaggatgaggctgtatttattactgtgcagcagtggacttacacctgagtnattctgggttgggtgtcgggcggagggccaggctgactgtcgtagtcgacgacccgaacggcctaccggtccccccgtcgggtacctaccgttccgttacccgtttaccccctacccccgttcccctccgacccggtaccgttagttcgttccgtagggaccggtcggggcgtacgggaccgaacgggtccgactaagtcgncnnngnnnnnnnn

SEQ ID NO: 404254 - DNA, 527 bp, Homo sapiens
  misc_feature: GZ8MTXP02JK502.22.28.C06.1.454.CMB.2.raw
  modified_base (330)..(330): a, c, t, g, unknown or other
  modified_base (426)..(426): a, c, t, g, unknown or other
  modified_base (516)..(527): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggccccccaaactcctcatgtatgacagtagtgagccggccctcgacggggtccctgacccgtattcctctggctctaagtctggccacctcggcctcctggacatcagtcggccctccggtccgaggntggaggctgtattatactgtgcagcagtggatacaacgtgagtgattcgtggttgggtgtcggcggaggcagctgccgtcgagtcacgccgacgcnccgccccgtcgtcacttcgtccgtccccgtccctcccgtcgaccgtcgtactcgtcgtggtggccggtgtcggcgaacggcgacgagtgnnnnnnnnnnnn

SEQ ID NO: 404255 - DNA, 613 bp, Homo sapiens
  misc_feature: GZ8MTXP02H60X9.22.28.C06.1.454.CMB.2.raw
  modified_base (244)..(244): a, c, t, g, unknown or other
  modified_base (263)..(263): a, c, t, g, unknown or other
  modified_base (278)..(278): a, c, t, g, unknown or other
  modified_base (345)..(345): a, c, t, g, unknown or other
  modified_base (351)..(351): a, c, t, g, unknown or other
  modified_base (356)..(356): a, c, t, g, unknown or other
  modified_base (360)..(360): a, c, t, g, unknown or other
tcagacatacgcgtcacgaccggtgctcgatttagagctcacgtattgggtttgggagcttcagctgtggtagagaagacaggattcaggacaatctccagcatggccggcttccctctcctcctcaccctcctcactcactgtgcagggtcctgggcccagtctgtgttgactcagccaccctcagcgtcgtcgggacccccggcagagggtcaccatctcttgttctggaagcgactccaanagtcggcgatactcatgtntactggtaccaacgnggtcccgagggaccggacccccaaactcctcatgtatgacagtagtgagcggcctgacggggtcccngaccgntctcngctntagtctgcacctcgtcctcctggacatccagtcggaccgtccggtccgagtacgtgaggtctagtatttagttactggtcgacaggcaggtacgggtaattaaccgaacgtggagttagacttccggttagggttggggttacggttcggggcggaaacgggggccgtaacgggtccgtacgggtaacccgttaaccggtaaggggtacccaaccgggaccccgaaacgggtcccgttacccggtccccccgg

SEQ ID NO: 404256 - DNA, 548 bp, Homo sapiens
  misc_feature: GZ8MTXP02JGVRL.22.28.C06.1.454.CMB.2.raw
  modified_base (243)..(243): a, c, t, g, unknown or other
  modified_base (395)..(395): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaanatcggcgatactcatgtgtactggtaccaacacggtcccagggacccggccccccaaactccctcatgtatgacagtagtgagccggccctcgacggggtccctggaccgtacttctcgtggctctaagtctggccaccgtcggccctccgnggacatcagtcggccctccggtccgagatggaggctgattattacgtgtgctgcagtggatacactgagtgatcgtaggttcgggtgttcgggcgggtaggacacgggctggacccgtcgtaggtccacggcccgaaggtcctcggtcccccg

SEQ ID NO: 404257 - DNA, 502 bp, Homo sapiens
  misc_feature: GZ8MTXP02JGJJ3.22.28.C06.1.454.CMB.2.raw
  modified_base (496)..(502): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccccaaactcctcatgtatgacagtagtgagcggccctcaggggtccctgaccgattctctggctctaagtctggcacctcggcctccctggacatcagtggccctcggtccgaggatgaggctgattattactgtgcagcatgggattacaacctgatgattcctgttgggtgttcgggcggaggggaccaggctgaccgtctaggtcagcccaaggctcgccccctggtccacgtctcgttcccaccctcctcacgcgtatgtctgacgcgggctggcaagggcgcatagnnnnnnn

SEQ ID NO: 404258 - DNA, 561 bp, Homo sapiens
  misc_feature: GZ8MTXP02IFD2D.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagccggcctcgacggggtccctgaccgtattctctggctctaagtctggccacgtccggccctccccgtggactactcgagtcggcccgtccgggtccgaggagtggaggcgtgtatttattacttgtcgctagctagtgggtattaacgactgagtgactcgtaggttgggtgttcgggcggtacggaccgtaggctcgaccgtcgtacggtcacgtccgaacggtcctccgtcccccg

SEQ ID NO: 404259 - DNA, 515 bp, Homo sapiens
  misc_feature: GZ8MTXP02F92KV.22.28.C06.1.454.CMB.2.raw
  modified_base (262)..(262): a, c, t, g, unknown or other
  modified_base (506)..(515): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggccccccaaatcctcatgtatgacagtagtgagcggccctcaggggtccctgaccgattcnctggctctaagtctggcacctcggcctccctggacatcagtcggcctccggtccgaggatgaggctgattatactgtgcagcagtgggacttacacctgatgattccgtagtgggtgttcggcggagggaccagggctgacccgtctagtcagcccgaaggctcgccccctcggtccacgtctccgttcccgccctcctcacgcgtactgtctgacgcgggctcgggcgaacggcgacagtagnnnnnnnnnn

SEQ ID NO: 404260 - DNA, 532 bp, Homo sapiens
  misc_feature: GZ8MTXP02HJIBE.22.28.C06.1.454.CMB.2.raw
  modified_base (466)..(466): a, c, t, g, unknown or other
  modified_base (522)..(532): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtcggcctccggtccgaggatgaggctgattattactgtgcagcatgggattacaacctgagtgatcctggttgggtgttcgggcggagggggaccagggtcgtgaccgtccgtacggtcacggccctaaggcctcgcccccgtcggtccactcctcgttccccncccttcctccacgcgtactcgtctggacgcgggcgtcggcgaacggcgcagtagcnnnnnnnnnnn

SEQ ID NO: 404261 - DNA, 574 bp, Homo sapiens
  misc_feature: GZ8MTXP02G8DA1.22.28.C06.1.454.CMB.2.raw
  modified_base (407)..(407): a, c, t, g, unknown or other
  modified_base (561)..(574): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggccccccaaactcctcatgtatgacagtagtgagccggccctcgaggggtccctgaccgattctctggctctaagtctggcacctcggcctccctggacatcagtggccctccgggtccgaggatggaggctgtattattactgtgcagcagtggactacactgagtgattcgtggttggggtgttcggggacgggaggggaccngggctacgcccgtccgtaggtcacggcccgaaggccctccgcccccgtcgggtcctaccgttcccttcccgttcccccacccccttccctcccgtaccgtcgttacgtcgttcgtcggacgggtcgggcgtcgggacgaacgggccggacagtnnnnnnnnnnnnnn

SEQ ID NO: 404262 - DNA, 505 bp, Homo sapiens
  misc_feature: GZ8MTXP02JAYR6.22.28.C06.1.454.CMB.2.raw
  modified_base (342)..(342): a, c, t, g, unknown or other
  modified_base (382)..(382): a, c, t, g, unknown or other
  modified_base (452)..(452): a, c, t, g, unknown or other
  modified_base (487)..(487): a, c, t, g, unknown or other
  modified_base (491)..(493): a, c, t, g, unknown or other
  modified_base (495)..(505): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagtcgactccaacatcggcgatactcatgtgtactggtaccaacaggtcccagggacggcccccaaactcctcatgtatgacagtagtgagcgggccctcaggggtccctgaccgattctctggctctaagtctggcacctcggcctccctggacatcagtggcctccggtccgaggatggaggctgattattactgtncagcatgggattacaacctgatgatctgtgggtgttcggnggagggaccaggctgaccgccgtagtcagcccaaggctcgcccctcgtccactctcgttcccgccctccncacgcgtatcgtctgagcggctggcaacggccganacgnnncnnnnnnnnnnn

SEQ ID NO: 404263 - DNA, 496 bp, Homo sapiens
  misc_feature: GZ8MTXP02FQ2WS.22.28.C06.1.454.CMB.2.raw
  modified_base (260)..(260): a, c, t, g, unknown or other
  modified_base (333)..(333): a, c, t, g, unknown or other
  modified_base (375)..(375): a, c, t, g, unknown or other
  modified_base (448)..(448): a, c, t, g, unknown or other
  modified_base (461)..(461): a, c, t, g, unknown or other
  modified_base (478)..(478): a, c, t, g, unknown or other
  modified_base (483)..(496): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacgcccccaaatcctcatgtatgacagtagtgagcggccctgaggggtccctgaccgattcnctggctcaagtctggcacctcgcctccctggacatccagtggcctccggtcaggatgaggtctgatttatacngtgcagcagtggattacactgactgatctggtggtgttcggngtaggaccaggtctgaccgtctaggtcagtcccgagcctcgccccctggactactctacgttcccacccttcncacgcgtatgtcngagcggctggcacggcngatgnnnnnnnnnnnnnn

SEQ ID NO: 404264 - DNA, 700 bp, Homo sapiens
  misc_feature: GZ8MTXP02IJG7P.22.28.C06.1.454.CMB.2.raw
  modified_base (313)..(313): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattacactggacctggatccggcacgtccccagggcagggactggaatggattggattatttcatacgactgcgatgaccaactcgaccaacccctcctcaggcctcgagtcagctgtcagtanacacgtacaagaaccagtaccttccgagacgactgtacccctcgtgtacgaccgcgacgacgaccgacgtccgtgttactttcgtgtacggttcggtacgtagtcgtaccagtcgactacgtacaaacaaaacgtaacgtcggtaccctaccggttacggggacccgtaaacggggtaaacccgttcggggtacccctaacccgggttcctacccgttaccgaaccggtcccctaacccgaacccgaacggggtaccccctacggtacccgggtttccccttacccccgtcgggtaaccccctaccccgtttaccccaaccggtaaccggaacctcccgtaaacccggttccggtacgggggacccaacggaccgggtcccccgggg

SEQ ID NO: 404265 - DNA, 555 bp, Homo sapiens
  misc_feature: GZ8MTXP02HU6OM.22.28.C06.1.454.CMB.2.raw
  modified_base (291)..(291): a, c, t, g, unknown or other
  modified_base (365)..(365): a, c, t, g, unknown or other
  modified_base (475)..(475): a, c, t, g, unknown or other
  modified_base (543)..(555): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacgcccccaaatcctcatgtatgacagtagtgagcggccctgaggggtccctgaccgtattctctggctctaagtctggcacctcggcctccnggacatcagtcggccctccggtcgaggatggaggctgatttattactgtgcagcagtggacttacacctgagtnattctggttgggtcttcggggcggtaggggaccagggtcgtcgaccgtccgtaggtcacgacccgaagggcctcgcccccgtcggtaccaccttccgttccggttccccnccccttcctccaccgtccgttagtcgtccgtggcggcgggtcgtcggacgaacgggcgacgataggcnnnnnnnnnnnnn

SEQ ID NO: 404266 - DNA, 633 bp, Homo sapiens
  misc_feature: GZ8MTXP02IURQH.22.28.C06.1.454.CMB.2.raw
  modified_base (187)..(187): a, c, t, g, unknown or other
  modified_base (283)..(283): a, c, t, g, unknown or other
  modified_base (624)..(633): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaanaggtcccagggaccggccccccaaactcctcatgtatgacagtagtgagccggccctcgaggggtccctgaccattctctggctctaagtctggcncctcggccctccctggacatcgagtcggccctccgggtccgaggatgaggctgtatttattacgtgtgcagcagtgggacttaccactgagtgacttccgttgggttggggttcgttccgggggacgggacgggggaccgaggggtcgtacggaccggttcccgtagggtccgacggacccgaacgggtcccgtccgtccccccgttccgggtaccctcccgttccgttcccggtttcccccggcccccttccccgtaccgtaccggtaccgtacgttcggttccgttcgggacgggcccgggggcgtacggggcgaaacgggcccgagtacgagcgcgcnnnnnnnnnn

SEQ ID NO: 404267 - DNA, 642 bp, Homo sapiens
  misc_feature: GZ8MTXP02IIXFG.22.28.C06.1.454.CMB.2.raw
  modified_base (205)..(205): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggnagagggtcaccatctcttgttctggaagcgactccaacatcggcgtatactcatgtgtactggtaaccaacgacggtccccgaacgggaccggacccccccaaaacctccctcagtgtatgacagtagtggacgccggccctcggacggggtcccctgaccgtacttctcgtcgtcttactaagtccgtcggccctacccgtccgggtaccctcccgtaggaccactcgagttccggccctccgggtccgaggtatcggaggtcttagactttacgttaccgtggtcgacgaagtctaaggttacggggtaactttaaccgaccgtagtaacggttgtaaccggttacgttagggtttgggggtcggttcggggacggggtacggaccgtcggcgttcgaccggtctacgggtcacgtccgagtcctccgtcccccg

SEQ ID NO: 404268 - DNA, 565 bp, Homo sapiens
  misc_feature: GZ8MTXP02FN870.22.28.C06.1.454.CMB.2.raw
  modified_base (552)..(565): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctcctggacatcagtcggccctccgggtccgaggactggacggctgtattattacgtgtgcagctagtggggaacttaccgaaacctggagtgacttccgttagggttgggtggttcgggcggggagggaccgagggctgaccgtcctaggtcacgcccaaggccctcgtcccccgtcggtccacttcccgttcccgttcccccctcctcctaccgtcgttacgtcgtcgtgcgggcgggcgtgggcgaacggcgacgtgacgnnnnnnnnnnnnnn

SEQ ID NO: 404269 - DNA, 557 bp, Homo sapiens
  misc_feature: GZ8MTXP02IVVUU.22.28.C06.1.454.CMB.2.raw
  modified_base (372)..(372): a, c, t, g, unknown or other
  modified_base (543)..(543): a, c, t, g, unknown or other
  modified_base (545)..(548): a, c, t, g, unknown or other
  modified_base (550)..(557): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacgccccccaaatcctcatgtatgacagtagtgagcggccctgaggggtccctgaccgattctctggctctaagtctggcaccgtcggccctcctggaccatccaggtcggcccctccgggtccgaggatggaggctgtattattactgtgcagcagtggacttacactgagtnacttctggttgggtgttcgggcggaggggaccagggctcgaccgtcgtaggtcgacgacccgaaggcctccgcccccgtcggtccacgttcgtccgttccccgcccttcctcccgacgtccgtagtcgtacgtggacggcgggtcgtgggacgaacgggcgacgacgtggncnnnngnnnnnnnn

SEQ ID NO: 404270 - DNA, 515 bp, Homo sapiens
  misc_feature: GZ8MTXP02FVL4A.22.28.C06.1.454.CMB.2.raw
  modified_base (357)..(357): a, c, t, g, unknown or other
  modified_base (392)..(392): a, c, t, g, unknown or other
  modified_base (445)..(445): a, c, t, g, unknown or other
  modified_base (501)..(502): a, c, t, g, unknown or other
  modified_base (504)..(506): a, c, t, g, unknown or other
  modified_base (508)..(515): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgcccccaaactcctcatgtatgacagtagtgagtggccctgaggggtccctgaccgattcctctggctctaagtctggcacctcggcctcctggacatcagtggcctccggtccaggatgaggctgattatactgtgcagcatggattacacctgagnatcctagtgggtgttcggcggtagggacccaggcngaccgtcctagtcagcccgtaagcctcgccccctcggtcacctctcgttcccncccctacctcaccggctatcgtctgacgtcggacgtcggcaacggcgacacgagcnncnnngnnnnnnnn

SEQ ID NO: 404271 - DNA, 514 bp, Homo sapiens
  misc_feature: GZ8MTXP02F7FZP.22.28.C06.1.454.CMB.2.raw
  modified_base (264)..(264): a, c, t, g, unknown or other
  modified_base (368)..(368): a, c, t, g, unknown or other
  modified_base (503)..(514): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcgaggggtcccctgaccgattcnctggctctaagtctggcacctcggccctccctggacatcagtggccctccggtccgaggatgaggctgtattattactgtgcagcagtggacttacactgagtnatctgtgggtgttcggcggagggacaggctgccgtcgtagtcacgcccgaagcctcgcccccgtgcactctcgtccccgccctcctcaccgtcgtacgtcgtcgtggacgcgggcgtggcgaacggcgcagtagnnnnnnnnnnnn

SEQ ID NO: 404272 - DNA, 628 bp, Homo sapiens
  misc_feature: GZ8MTXP02JW5JL.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccggcagagggtcaccatctcttgttctggaagcgactccaacatcggcgatactcatgtgtactggtaaccaacgacggtacccgacgggacccggaccccccaaaactcccgtccatcgtatgacgagtagtggagccggccctcgacggggtccctgaccgacttctcgtggctctaagtctcggctacccgtcggccctcccgtggaccatcagtcgcccgtccggtccgagagtgacgtctgtattattacgtcgtgacgagacagtagggtactacgtaactaggtacgtgtacgtccgttagggttggggttcggtacgggtcgggggaacgggaccggtacgggtaccgtaccggtaccggttcccggtacggtaccggaccggtacccggaacgggtcccgtacccgttccccccggg

SEQ ID NO: 404273 - DNA, 618 bp, Homo sapiens
  misc_feature: GZ8MTXP02HFFSL.22.28.C06.1.454.CMB.2.raw
  modified_base (358)..(358): a, c, t, g, unknown or other
  modified_base (604)..(604): a, c, t, g, unknown or other
  modified_base (606)..(606): a, c, t, g, unknown or other
  modified_base (608)..(618): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgcccccaaactcctcatgtatgacagtagtgagccggccctcgaggggtcctgaccgtattctctggctctaagtctggccacctcggccctcccgtggacatcagtcggccccgtccggtcccgaggctaggaggctgtaatttattacgttggtncgagctagtggggtaacttaaccgaaccgtgacgtagtacttccgttagggtttggggttacggttccggggacggggaacggggaccgacgggcgtacgtacccgtaccgttacggccgacgaccccgtaggccctccggtcccccgtccgggtcctacctccgtttcccggtccccctcccccttccgtacccgtacgtccgtgttcgtccgttgacgggtcggcgtcggcaacggccgagacngncnnnnnnnnnnn

SEQ ID NO: 404274 - DNA, 503 bp, Homo sapiens
  misc_feature: GZ8MTXP02JY13L.22.28.C06.1.454.CMB.2.raw
  modified_base (368)..(368): a, c, t, g, unknown or other
  modified_base (387)..(387): a, c, t, g, unknown or other
  modified_base (455)..(455): a, c, t, g, unknown or other
  modified_base (457)..(457): a, c, t, g, unknown or other
  modified_base (492)..(503): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggcccccaaactcctcatgtatgacagtagtgagccggccctcgaggggtccctgaccgattctctggctctaagtctggcacctcggcctccctggacatcagtcggcctccggtccgaggctgaggctgacttattactgtgcagcatggacttacacctgagtnatctgttgggtgttcgggngagggacaggctgaccgtctaggtcagcccaggctcgccccctgtccacgtctcgttcccaccctccncncgcgtatgtctgcgcggctggcacggcgcatacgnnnnnnnnnnnn

SEQ ID NO: 404275 - DNA, 609 bp, Homo sapiens
  misc_feature: GZ8MTXP02H8YTX.22.28.C06.1.454.CMB.2.raw
  modified_base (186)..(186): a, c, t, g, unknown or other
  modified_base (247)..(247): a, c, t, g, unknown or other
  modified_base (259)..(259): a, c, t, g, unknown or other
  modified_base (540)..(540): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctnagcgtcgtcgggacccccgggcaggacgggtcacatctcttgttctggaagcgactccaanatcggcgatacncagtgtgtacgtggtaaccaacgacggtaccccgaggggacccgacccccaaacctcctacagttacgtatacgaacagttagtcgaggccggtccctacggacggggtcccctagaaccgtcttcctcgtgccttacgtaagtctcggcctaccgtccggtccctcccgtggactactcgagtcggcccgttccggacgagtacgtggaacggctagtattagttcgtgtcgactagcagtacggtataaccgacgtgagtgacgttcgtaggtttgggngtttcgggacgggacggacgtacggcgtacgaccgtcgtacgacacgacgacggtctacccggtccccg

SEQ ID NO: 404276 - DNA, 576 bp, Homo sapiens
  misc_feature: GZ8MTXP02H6HIH.22.28.C06.1.454.CMB.2.raw
  modified_base (388)..(388): a, c, t, g, unknown or other
  modified_base (563)..(576): a, c, t, g, unknown or other
tcagacatacgcgtcacgaccggtgctcgatttagagctcacgtattgggtttgggggccgtccctgggccccagtctgtgttgactcagccaccctcagcgtctgggaccccccgggcagagggtcaccatctcttgttctggaagcgactccaacatcggcgatactcatgtgtactggtaccaacaggtcccagggaccggcccccaaactcctcatgtatgacagtagtgagccggccctcgacggggtccctgaccgtattctctggctcgtaagtctggccaccgtccggccctccccgtggacatcagtcggcccctccggtccgaggactggacggtctgtatttattacgtgtgcagcagtggtactacaacctgagtnattccgtgttgggtgtcgggcggagggccgagctcgacccgtcgtaggcacggcccgaggtcctcccgtcccccgtcggtcctacctccgttcccgttcccccacccctttcctccgacggtccgttacgtcgtcgtggacgggccggtcgcgggaccgaacgggccgacagtgnnnnnnnnnnnnnn

SEQ ID NO: 404277 - DNA, 533 bp, Homo sapiens
  misc_feature: GZ8MTXP02FGUL7.22.28.C06.1.454.CMB.2.raw
  modified_base (294)..(294): a, c, t, g, unknown or other
  modified_base (521)..(521): a, c, t, g, unknown or other
  modified_base (523)..(533): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagcggccctcagggggtccctgaccgattctctggctctaagtctggcacctcggcctcccnggacatcagtggcctccgggtccgaggatgaggctgattatactgtgcagcagtgggacttacaacctgagtgactcgttaggttgggtggttcggcgggagggaccagggctcgaccgtccgtaggtcagcccgaaggcctacgcccccgtcgtaccacctctcgttccccacccttccctacaccgcgtactgtactggacggcgggctggacgacggcgtcagngnnnnnnnnnnn

SEQ ID NO: 404278 - DNA, 644 bp, Homo sapiens
  misc_feature: GZ8MTXP02IXSFR.22.28.C06.1.454.CMB.2.raw
  modified_base (209)..(209): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagcgtcgtcgggacccccgggnaggacgggtcaccatctcttgttcgtggaagcgactccaacagtcggcgatactcatgtgtactggtaccaacgacggtcccgagggacccggacccccaaactcctacatgtatgacagtagtcgacgccgcctcgacggggtccctagaccgtacttccgtcgtggtctacgtaacgtcgtcgggcctaccgtccggccctcccgtcggacacgtcgacggtccggcccgttaccgggaccggaaggtcgtcgggtaacgggtcctaggttaaatttcgttaccgtgtccgtgtccgttcttagttcgcgacggtcctaccgttaacgtcggtttcggggtacggtccgggacgggacggaccaaggtccgtcggtacccgtacgtacggcaaccggacccgacggcccgtccgcccccgtcggtacctcccg

SEQ ID NO: 404279 - DNA, 533 bp, Homo sapiens
  misc_feature: GZ8MTXP02FQMOS.22.28.C06.1.454.CMB.2.raw
  modified_base (406)..(406): a, c, t, g, unknown or other
  modified_base (427)..(427): a, c, t, g, unknown or other
  modified_base (488)..(488): a, c, t, g, unknown or other
  modified_base (498)..(498): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctcgggacccccggcagagggtcaccatctcttgttctggaagcgactccaacatcggcgatactcatgtgtactgtaccaacaggtcccagggaccggacccccaaactcctcatgtatgacagtagtgagccggccctcgacggggtccctggaccgtacttccgtactggcctcgtaacgttcgtcggccaccgtcggccctccgtggaccntcagtcggccgtcggtcgagncgagctgattatactgtgcagcagtgtactacactgacgtgactcgtagtggtgtggcggnggaccaggcngaccgtcgacggtcacggccacggctacgtccccg

SEQ ID NO: 404280 - DNA, 673 bp, Homo sapiens
  misc_feature: GZ8MTXP02JEAB7.22.28.C06.1.454.CMB.2.raw
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtgctccatcagtgattactactggacctggatccggcacgtcccagggcagggactggaatggattggattattccatacgactgcgatcgaccaactcgaccaacccctcctacgacgggcctcgagtccacgcctgtcagtacgacacgtacaagaaccagaccttccagacgtactcgacccctcacgtccgaccgccgacaacgaccgtaccggtccgttagttacttcgtcggttacggttaccgggtaacgtagttccggtaccagttcgaacgtactaccaaactaaaacgtacgtcgtccgttaccggcggggaccgaacgggtaccctgggtacccacccggtccttccgacgacgaccctacccgaacgaaccgggccctaccgttccggttaccccttcccccggcggtacccctaccccttaccgacccgaaacgcccgtaccgaacccggttcggggacggggacccaaccggacgtccccgggg

SEQ ID NO: 404281 - DNA, 570 bp, Homo sapiens
  misc_feature: GZ8MTXP02F3NCZ.22.28.C06.1.454.CMB.2.raw
  modified_base (275)..(275): a, c, t, g, unknown or other
  modified_base (559)..(570): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggcccccaaactcctcatgtatgacagtagtgagcggccctcgaggggtcccctgacccgattctcgtggcctntaagtctggccactcggcctcctggacatcagtcggccctccggtccgaggatgaggctgatttatactgtgcagcagtggacttacaactgagtgattcgtggttgggtggttcgggcgggacggggaccagggtcctacggacccgttaccgtacgggtcacggacccgaacggccctccggccccccgttacgggtccaccttccgtccgttccccgtccccctccctccaccgcgttactcgtcgcggtacggcgggcgtagggcgacgggccgcagtgnnnnnnnnnnnn

SEQ ID NO: 404282 - DNA, 536 bp, Homo sapiens
  misc_feature: GZ8MTXP02I58SL.22.28.C06.1.454.CMB.2.raw
  modified_base (325)..(325): a, c, t, g, unknown or other
  modified_base (490)..(490): a, c, t, g, unknown or other
  modified_base (501)..(501): a, c, t, g, unknown or other
  modified_base (524)..(536): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacggcccccaaactcctcatgtatgacagtagtgagccggccctcgaggggtccctgaccgattctctggctctaagtctggccacctcggccctcctggacatcagtcggccctccggtccgaggntggaggctagtattattacgtgtcgcagcagtggacttacactgagtgactcgtggttgggtgtcgggcggagggaccaggctcgaccgtcgtaggtcacgcccgaggcctccgcccccgtcggcacctctccgtccccaccctcctcgaccgtcgtactcgtcnggacgcgggtntcgggcacgggcgacacgtagcnnnnnnnnnnnnn

SEQ ID NO: 404283 - DNA, 614 bp, Homo sapiens
  misc_feature: GZ8MTXP02JUECI.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtcgtcgggaccccccggcaggagggtcaccatctcttgttctggaagcgactccaacatcggcgatactcatgtgtactggtaaccaacgacggtcccgagggacccggcccccaaactcctcatgtatgacagtagtgacgccgccctcgacggggtccctgaccgtacttctcgtcggctactaagtctcggccacccgtccggtccctccgtaggacctactcgaggtccggcccgtcccggtccggaaggtacgtggaggtcgttagtactttacgttacgtggtacgcgtagctaggtaggtacttacgactgagtgtacttcgtagggtttgggtcggttcgggcgggacgggaccgacggccgtacggtacccgtccgtaggtaccgacggtacccgacggtccctccggtcccccg

SEQ ID NO: 404284 - DNA, 527 bp, Homo sapiens
  misc_feature: GZ8MTXP02I6O5J.22.28.C06.1.454.CMB.2.raw
  modified_base (395)..(395): a, c, t, g, unknown or other
  modified_base (467)..(467): a, c, t, g, unknown or other
  modified_base (496)..(496): a, c, t, g, unknown or other
  modified_base (512)..(514): a, c, t, g, unknown or other
  modified_base (516)..(527): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacgccccccaaatcctcatgtatgacagtagtgagccggccctcgagggggtcccctgaccgtattcctctggctctaagtctggcacctcggccctcctggacatcagtggccctccggtccgaggctgaggctttattattctgtgcagcagtggattaccaacctgagtgatcctaggttggggttgtacgggnggacggacaggctagaccgtcgtaggtcagcccaagggctccgcccctcgctacgtctcgtccccaccctcnccacgtcgttactcgtggacgcggggtcnggacgaggcagagagnnncnnnnnnnnnnnn

SEQ ID NO: 404285 - DNA, 509 bp, Homo sapiens
  misc_feature: GZ8MTXP02HEREH.22.28.C06.1.454.CMB.2.raw
  modified_base (399)..(399): a, c, t, g, unknown or other
  modified_base (406)..(406): a, c, t, g, unknown or other
  modified_base (419)..(419): a, c, t, g, unknown or other
  modified_base (430)..(430): a, c, t, g, unknown or other
  modified_base (440)..(440): a, c, t, g, unknown or other
  modified_base (456)..(456): a, c, t, g, unknown or other
  modified_base (458)..(458): a, c, t, g, unknown or other
  modified_base (463)..(463): a, c, t, g, unknown or other
  modified_base (470)..(470): a, c, t, g, unknown or other
  modified_base (495)..(495): a, c, t, g, unknown or other
  modified_base (497)..(509): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccaggggaccgccccccaaactcctcatgtatgacagtagtgagccggccctcgaggggtcccctgaccgtattctctggctctaagtctggccaccgtcggccctcctggacatcagtcggccctcggtccgaggactggaggctagtaatttattacgtgtgcagcagtggacttacaactgatgattcgtggtgggtgtcgggnggaggcnggctcgccgtcgngcacgccagcncgccctcgcnctctcgtcccacctcncncgctntcgtcgnggcgcggcgtcgacgacggcgcagngnnnnnnnnnnnnn

SEQ ID NO: 404286 - DNA, 661 bp, Homo sapiens
  misc_feature: GZ8MTXP02IAPNQ.22.28.C06.1.454.CMB.2.raw
  modified_base (186)..(186): a, c, t, g, unknown or other
  modified_base (231)..(231): a, c, t, g, unknown or other
  modified_base (246)..(246): a, c, t, g, unknown or other
  modified_base (259)..(259): a, c, t, g, unknown or other
  modified_base (495)..(495): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctnagcgtcgtcgggaccccccggaggagggtcaccatctcttgttcnggaagcgactccaanatcggacgatacncatgtgtactggtaaccaacgacggtcccgagggacccggacccccaaactcctacactgtatgacaggtagtgaggccggtccctcggacggggtcccctgaccgtaccttccgtccgtgccttagttaacgtccgttgggccctaccctccgggtccctacccgtagggactactcccgaggtccggcccgttaccggccgaggtatggacgtctagtattatagtgtgagagntaggtaggtactaaccgtaaccgttggagttacgtacttccgggttacggtttgggggttacggtttcggggacgggtacggggaccgacgggtaccgtcggtacccggtaacccgttaggtacccgaccggaaacccggtacgcccggtacccgttccccccggg

SEQ ID NO: 404287 - DNA, 508 bp, Homo sapiens
  misc_feature: GZ8MTXP02HFFFN.22.28.C06.1.454.CMB.2.raw
  modified_base (240)..(240): a, c, t, g, unknown or other
  modified_base (313)..(313): a, c, t, g, unknown or other
  modified_base (331)..(332): a, c, t, g, unknown or other
  modified_base (334)..(335): a, c, t, g, unknown or other
  modified_base (337)..(337): a, c, t, g, unknown or other
  modified_base (343)..(343): a, c, t, g, unknown or other
  modified_base (346)..(346): a, c, t, g, unknown or other
  modified_base (349)..(350): a, c, t, g, unknown or other
  modified_base (364)..(364): a, c, t, g, unknown or other
  modified_base (374)..(374): a, c, t, g, unknown or other
  modified_base (493)..(493): a, c, t, g, unknown or other
  modified_base (495)..(503): a, c, t, g, unknown or other
  modified_base (505)..(505): a, c, t, g, unknown or other
  modified_base (507)..(508): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggacgcccccaaatcctcatgtatgacagtagtgagcggccctnaggggtccctgaccgattctctggctctaaagtctggcacctcggcctccctgacatcagtgcctcggcaggntgaggctgattatactgnnannangactanacngannatctgtggtgtcgngagacgagcncacgtacgtagtcgacgaccgacgcgcgcccgtccgtctactctcgtccctaccctacctaccacgtacgtacgtagtcgtcgacggcggcgtacggacgaacggacgacaacgtaganannnnnnnnncncnn

SEQ ID NO: 404288 - DNA, 596 bp, Homo sapiens
  misc_feature: GZ8MTXP02FS9IV.22.28.C06.1.454.CMB.2.raw
  modified_base (258)..(258): a, c, t, g, unknown or other
  modified_base (262)..(262): a, c, t, g, unknown or other
  modified_base (268)..(268): a, c, t, g, unknown or other
  modified_base (573)..(573): a, c, t, g, unknown or other
  modified_base (581)..(582): a, c, t, g, unknown or other
  modified_base (584)..(586): a, c, t, g, unknown or other
  modified_base (588)..(591): a, c, t, g, unknown or other
  modified_base (593)..(593): a, c, t, g, unknown or other
  modified_base (595)..(596): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgcccccaaactcctcatgtatgacagtagtgagccgccctgacgggtccctgaccgnttcntggctntaagtctggccacctcggccctcctggacatcgagtcggcccgtccggtccgaggatcgaggtctagtattattactggtgcagcagtggattacgacctgagtgacttcgttgggttgggtggttacggggacgggtacggggccgtaagggcgtacggtacccgttccgtacggtcacgacccgaacggcctcccgcccccgttcggtaccctctacccgttccgttaccccctacccctccctcctaccggtccgtagttcgtcgtacggcggccgggtcgtacgggaccgaaggcccgganacgtagcnncnnngnnnncncnn

SEQ ID NO: 404289 - DNA, 503 bp, Homo sapiens
  misc_feature: GZ8MTXP02GSC2Q.22.28.C06.1.454.CMB.2.raw
  modified_base (384)..(384): a, c, t, g, unknown or other
  modified_base (420)..(420): a, c, t, g, unknown or other
  modified_base (492)..(492): a, c, t, g, unknown or other
  modified_base (494)..(503): a, c, t, g, unknown or other
tcagacatacgcgtcacgaccggtgctcgatttagagctcacgtattgggtttgggggccgtccctgggcccagtctgtgttgactcagccaccctcagcgtctggggaccccccgggcagagggtcaccatctcttgttctggaagcgactccaacatcggcgatactcatgtgtactggtaccaacaggtcccagggaccgcccccaaactcctcatgtatgacagtagtgagccggccctcgacggggtccctgaccgtattctctggctctaagtctggcacctcggcctccctggacatcagtcgcctccggtccgaggatgaggctgattattactgtgcagcagtggacttacaactgatgatctgttggtgtcggnggaggacaggctgaccgtctagtcagcccaaggccncgccccgtcggtcacgtctccgttcccaccctcctccacgtctatcgtcgtgcgcgggctggcaaggccganannnnnnnnnn

SEQ ID NO: 404290 - DNA, 656 bp, Homo sapiens
  misc_feature: GZ8MTXP02FVYWY.22.28.C06.1.454.CMB.2.raw
  modified_base (548)..(548): a, c, t, g, unknown or other
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcacgtcccagggcagggactggaatggattggattattccatacgactgcgatgaaccaactcgaccctaaccccctcccgtcgacgggcctcggacgtccagtcctggtcaggtacgaccaccgtaccaaacgaacccagacctttcccagacgacctcgacccctcgtcgtcgacccgccgacaacgccgaccgggcgttgttactttcgtggtcggtacggtacgtagtcgtaccaagtcgactacgtaccaaactaaaacgacgttcggtccgtaccgggtcggggaccgaacggggtaccccgtggttacccgacccgttccctccgaccncgtacccaccgaaccgacggtcccctacgtcccggttccccttccccgtcggaccctaccccgtccaccgaacgaaccgtccaccgtcggcgggaccacgcggcccgg

SEQ ID NO: 404291 - DNA, 542 bp, Homo sapiens
  misc_feature: GZ8MTXP02FYW0B.22.28.C06.1.454.CMB.2.raw
  modified_base (346)..(346): a, c, t, g, unknown or other
  modified_base (504)..(504): a, c, t, g, unknown or other
  modified_base (513)..(513): a, c, t, g, unknown or other
  modified_base (529)..(542): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggccccccaaatcctcatgtatgacagtagtgagccggccctcgaggggtccctgaccgtattctctggctctaagtctggcacctcggcctccctggacatcagtggacctccgggtccgaggatgaggctagattatactgtncagcagtgggatttaccacgtgagtgactccgttagggttgggtgtttcggggaccgggaggaccgtagggctacggacccgttccgtaggtccagacccgaagctcgccccctcggtaccactctcgttcccaccccgtcctcaccgcgtactgtcngtacgcggntcggagacgctcagannnnnnnnnnnnnn

SEQ ID NO: 404292 - DNA, 616 bp, Homo sapiens
  misc_feature: GZ8MTXP02ILQ39.22.28.C06.1.454.CMB.2.raw
  modified_base (207)..(207): a, c, t, g, unknown or other
  modified_base (380)..(380): a, c, t, g, unknown or other
  modified_base (476)..(476): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccactctcagcgtcgtcgggacccccggnaggaggtcaccatctcttgttctggaagcgactcaacatcggcgaatactacatgtgtaactggaaccaaacgacggtacccgacgggacccgaccccccaaactcctacatgtatagactaggtagtagacggccgcccgtcgtacggggtcccctgtaccccgtatttccncgtaggtctacttaagtcgtggccaccgtccgccctaccgtgacatcagtcgccgtccggtccgagcgtaggagctagtattattacgtgttacgngacgagtagtacgtaactaacgacgtgtagtagtacgttacggttagggttcgggtcggtacgggacggggtacggacgtacggtaccgtaccggtaaccgttacgtacggtaccgaccgtaccgacggtcccgtacccg

SEQ ID NO: 404293 - DNA, 544 bp, Homo sapiens
  misc_feature: GZ8MTXP02I52T4.22.28.C06.1.454.CMB.2.raw
  modified_base (303)..(303): a, c, t, g, unknown or other
  modified_base (327)..(327): a, c, t, g, unknown or other
  modified_base (371)..(371): a, c, t, g, unknown or other
  modified_base (530)..(531): a, c, t, g, unknown or other
  modified_base (533)..(537): a, c, t, g, unknown or other
  modified_base (539)..(544): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggccccccaaactcctcatgtatgacagtagtgagccggccctcgacggggtccctgaccgtattctctggctctaagtctggcacctcggcctcctggacntcagtcggccctccggtccgaggntgaggctgattattactgtgcagcagtggacttacaactgagtnattcgtggttgggtgttcggcggagggccaggctgaccgtcgtaggtcacgcccaggcctcgcccccgtcgcactctccgttccccgccccttcctccaccgtcgtacgtcgtcgtcggacggcgggtcgtacgggccgaacgggcgacgacgtaggcnncnnnnncnnnnnn

SEQ ID NO: 404294 - DNA, 583 bp, Homo sapiens
  misc_feature: GZ8MTXP02IE5CU.22.28.C06.1.454.CMB.2.raw
  modified_base (420)..(420): a, c, t, g, unknown or other
  modified_base (433)..(433): a, c, t, g, unknown or other
  modified_base (487)..(487): a, c, t, g, unknown or other
  modified_base (568)..(568): a, c, t, g, unknown or other
  modified_base (570)..(583): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccggccccccaaactcctcatgtatgacagtagtgagccggccctcgaggggtccctgaccgattctctggctctaagtctggccaccgtccggccctcccgtggacatcgagtcggcccctccgggtccgaggacgtggacggtctgtatttattacgtgtgcagctagtgggtactaaccactgtagtgacgtcgttggggtttgggtggttccggggngggacggggacgngggctcggtaccgtccgtagcgacgcccgaggcctcccggcccccgtcggtccnccttcgttcccccgtcccgtcccctccgtacctcggtaccgtgtcgtcgtaggcggtccggtgcggaccgaggccgagagngnnnnnnnnnnnnnn

SEQ ID NO: 404295 - DNA, 610 bp, Homo sapiens
  misc_feature: GZ8MTXP02J099M.22.28.C06.1.454.CMB.2.raw
  modified_base (188)..(188): a, c, t, g, unknown or other
  modified_base (541)..(541): a, c, t, g, unknown or other
  modified_base (596)..(596): a, c, t, g, unknown or other
  modified_base (598)..(610): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacnggtcccaggggaccggcccccaaactcctcatgtatgacagtagtgagccggccctcgacggggtccctgaccgtattctcgtggctctaagtctggccacctcggcctcctggacatcagtcgcctccggtcgaggctgaggctgatttatactgtgcagctagtggacctacaacctgacgtgacttcgtgggtgggtcggttcgggcgggacggggacctagggccgtcgtacccgtcgtaacgggtaccgaccgacccgaacggtcccgacccggtcccccgtcggtcctacctttcccgttacccgttccccctacccccgtccgtacccgtaccggtaccgtttacnccgtttcggaccgggtcgggccggggcgtacgggacgaacgggcaccgaacggcncnnnnnnnnnnnnn

SEQ ID NO: 404296 - DNA, 732 bp, Homo sapiens
  misc_feature: GZ8MTXP02I0U05.22.28.C06.1.454.CMB.2.raw
tcagacatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggactccggcacggtccccgagggcagggactggaatggattggattacttcatacgactgcgatcgaaccaatcgacctaacccctccacgaggcctcggacgtcaggtcctgtacagtacgacctacgtaccaaacgaaccacgtaacctttcccgagacgtacgtacgaccccctgtacggtacgacccgccgacgtaaggacccgaccggtacgtttacggttactttcgtacgggtacgggttaccgggttacggtaacgtccggtacctaagttcgaacgacgtaccaaaacgtaaacgtaaccgtacggtccgttacccgggtacggggacccggaaccggggtacccgtaccgggttaccgtacccggttccctccgtaccgaccgtaccccttacccgaaccggaaccggtccccgtaacggttccccggttccccgttcccccgtacggcccctacccctaccgtacccgacgtaaccgacctccggtacgggccggggaccaccggacgggtccccg

SEQ ID NO: 404297 - DNA, 549 bp, Homo sapiens
  misc_feature: GZ8MTXP02G0UX7.22.28.C06.1.454.CMB.2.raw
  modified_base (356)..(356): a, c, t, g, unknown or other
  modified_base (450)..(450): a, c, t, g, unknown or other
  modified_base (490)..(490): a, c, t, g, unknown or other
  modified_base (505)..(505): a, c, t, g, unknown or other
  modified_base (517)..(517): a, c, t, g, unknown or other
  modified_base (536)..(536): a, c, t, g, unknown or other
  modified_base (539)..(549): a, c, t, g, unknown or other
tcagacatacgcgtcacgaccggtgctcgatttagagctcacgtattgggtttgggggccgtccctgggccccagtctgtgttgactcagccaccctcagcgtctgggaccccccgggcagagggtcaccatctcttgttcctggaagcgactccaacatcggcgatactcatgtgtactggtaccaacaggtcccaggggaccggccccccaaactcctcatgtatgacagtagtgagccggccctcgaggggtccctgaccgtattctcgtggctctaagtctggcaccctcggccctccctggacatcagtcggccctccggtccgagggatggaggctgtattattactgtncagcagtggattacaactgagtgatctaggttgggtgttcgggacgggaggaccgaggctcgacccgtaccgttaggaccagacccgaaggccncccgccccctcggacctcctcttccgtcccaccccttccncacgcgtactgttcnggaggccggtcnggacgaagggccacgtaanagnnnnnnnnnnn

SEQ ID NO: 404298 - DNA, 691 bp, Homo sapiens
  misc_feature: GZ8MTXP02JDIKQ.22.28.C06.1.454.CMB.2.raw
  modified_base (647)..(647): a, c, t, g, unknown or other
  modified_base (675)..(675): a, c, t, g, unknown or other
  modified_base (678)..(678): a, c, t, g, unknown or other
  modified_base (680)..(691): a, c, t, g, unknown or other
tcagacatacgcgtcacgaccggtgctcgatttagagctcacgtattgggtttgggggccgtccctgggcccagtctgtgttgactcagccaccctcagcgtctcgggaccccccgggcagagggtcaccatctcttgttctggaagcgactccaacatcggcgatactcatgtgtactggtaccaacacggtcccagggaccggccccccaaactcctcatgtatgacagtagtgagccggccctcgacggggtccctggaccgtattctctggctataagtctcggcaccgtcggccctcctggacatcgagtcggcccctccgggtccgaggctggaggtctaggtaatttacttacgtggtcgtacagtacgaagttcggggtaacctttaaccgaaccgttggtaaacggttgtaaccttcggttagggggttttcggggtcgggttaccggggccggggtaagggggtaccctacggggtcttacccgggtacccgttccggttaacgggccaaccgaccccggttaacgcccgtcccggtaacccccctttcgggcccttaaccgttcccggttccccttaccccctcccccttccctcccggtaacccgtcgtttaacgcgttcgaacggtcccggggnggtacggacggacgtaccggcgtacagngcncnnnnnnnnnnnn

SEQ ID NO: 404299 - DNA, 715 bp, Homo sapiens
  misc_feature: GZ8MTXP02JXK9X.22.28.C06.1.454.CMB.2.raw
  modified_base (294)..(294): a, c, t, g, unknown or other
  modified_base (314)..(314): a, c, t, g, unknown or other
  modified_base (326)..(326): a, c, t, g, unknown or other
  modified_base (330)..(330): a, c, t, g, unknown or other
  modified_base (338)..(338): a, c, t, g, unknown or other
  modified_base (355)..(355): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacgccccaaactcctcatgtatgacagtagtgagcggcctgacggggtccctgaccgattctctggctctaagtctggcacctcggcctcctggacntcagtcgcctccggtcgagntgaggctgattntacngtgcagcngtggactacactgagtnacgtcgttggtcgggtgttcgggaggacgggaccgaaggtccgtcgtaaccccggttacgtaacgggtacccaacggacccccgtaaaggggtcccgtacccggtacccccccgttacggggttacccctaaccggttacccgtttacccggttttacccccccaaaccccgtttccccgttaacccggaacccggggttacccgttaaacgtttccggggtaccttacgggggtaaccgggcccgggggttaaccgtacgggggaacccgtaaacgggggtacccgtacccgtaaaacggtcccgggtaacacgtacgtacgacgtaacgtacgtacgtacgacgacgtacgacgtacg

SEQ ID NO: 404300 - DNA, 650 bp, Homo sapiens
  misc_feature: GZ8MTXP02HLFSC.22.28.C06.1.454.CMB.2.raw
  modified_base (281)..(281): a, c, t, g, unknown or other
  modified_base (332)..(333): a, c, t, g, unknown or other
  modified_base (626)..(626): a, c, t, g, unknown or other
  modified_base (633)..(633): a, c, t, g, unknown or other
  modified_base (635)..(635): a, c, t, g, unknown or other
  modified_base (637)..(637): a, c, t, g, unknown or other
  modified_base (639)..(641): a, c, t, g, unknown or other
  modified_base (643)..(650): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacacggtcccagggaccgccccccaaactcctcatgtatgacagtagtgagccgcctcgacgggtccctgaccgtattctcgtggctctaagtcgnggccacccgtcggccctccgtggacatcgagtcggcccctccggtcgaggnnggacgctagtattattactgtgcagcaggtggtaactaccaacgtgagtcgtaacgttcgttaggggtttcgggttcggttaccgggggaccgggaacggggtacccgaggggtacccgttaccggtacccggtttccgttaacggtccgaacccggtacccgaaacgggtcccgtccccggtccccccgttaggtcccttaccgttccccgtttacccggttaccccctcccgtttccccgcgtaccggtcttacgtcgtacgtcgggcgtcggtacgcgggaccgacggcngtaacgngncncnnngnnnnnnnn

SEQ ID NO: 404301 - DNA, 688 bp, Homo sapiens
  misc_feature: GZ8MTXP02G6I1D.22.28.C06.1.454.CMB.2.raw
  modified_base (249)..(249): a, c, t, g, unknown or other
  modified_base (281)..(281): a, c, t, g, unknown or other
  modified_base (309)..(309): a, c, t, g, unknown or other
  modified_base (315)..(315): a, c, t, g, unknown or other
  modified_base (348)..(348): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagcccaccctcagccgtcgtcgggacccccgggcaggagggtcaccatctcttgttctggaagcgactccaanatcggcgatactcatgtgtactggtaccaacnggtacccagggaccgcccccaaatcccnatgtangacagtagtgacgcggtccctgacggggtcccngaccgactttccgcgtggcctagtaacgtctgggacctacccgtccggccccttcccgtaggacctacgtaccgtaggtccggtacccgttccggggtacccggaagggacgttagggacggtaccgttagttaatttacgtttaaacgtggttacgcgaagccgaaggttacggtaaattaaaccgtacgtacggtaagttcggtacgttacccgttagggtttacgggttcgggtttaccggggacgggtacggggtaaacccgtggggtaccctacggtacccgtaaccggtaacgtcggacccgtacccgaacggttcccgtacccggttcccccg

SEQ ID NO: 404302 - DNA, 680 bp, Homo sapiens
  misc_feature: GZ8MTXP02FM7XT.22.28.C06.1.454.CMB.2.raw
  modified_base (339)..(339): a, c, t, g, unknown or other
  modified_base (662)..(662): a, c, t, g, unknown or other
  modified_base (678)..(678): a, c, t, g, unknown or other
tcagacatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacgaggtcccgaggggaccggaccccccaaactcctacatgtatgacagtagtgacgccggccctggacgggtccctagaccgtattctcgtggctactaagtcgtggccacccgtcggccctccgagacatcagtcggaccgtccggtcgaggngtcggagcgtgtattactacgtgtacgcagcgtagtggtaccttaccacgtagatgtacgttcgttgggtgggtcggttcggacggggacgggtacgagggtctacggtaccgttaccgtaacggtaccacggtacccgacggtccgtcccggtacccccgtacggtacctaccttccgtttaccccgttacccccgtacccccttccgtacccgtaccgggttaccgttaacgttcggtttaccgaggggttacccggaccggggtacgtacgggtacggaaaaccggtcggtaaccgaacggtaacggcgcgtcgtacgcncgcgcgcacgcgcacncg

SEQ ID NO: 404303 - DNA, 761 bp, Homo sapiens
  misc_feature: GZ8MTXP02FRSV1.22.28.C06.1.454.CMB.2.raw
  modified_base (207)..(207): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtcgtcgggacccccggnaggagggtcaccatcttcttgttctggaagcgactccaacatcggcgatactcatgtgtactagtaccaacgacggtccccgagggaccccggaccccccaaactccctacatagtagtagacagtagtaggacgcccggcccgtcggtaccggggtccctacggaccggtacttcccgtcgtcggtcttacgttaacgttccgtcgggccctacccggtccggcccttccccgtagggactacgtccgtacggtcccgggtcccgtacccggggtcccgtaaggggtacgtacggggtaacggtcgttaggttaaactttactttaaccggttggttccgacgtagacccgttaagggttacggggttaaaaccttaaccccggtaaaccgttaggggttaaacgttggtaacccgtttaccggtttaaggggtttccgggggtacgggtttcgggggaacccggggaacgggggtaccgaccgggtccgtaccggtacccgtccgtacggtaccgaccggtacccggacgggcccttccccggttcccccgg

SEQ ID NO: 404304 - DNA, 500 bp, Homo sapiens
  misc_feature: GZ8MTXP02G3HRY.22.28.C06.1.454.CMB.2.raw
  modified_base (240)..(240): a, c, t, g, unknown or other
  modified_base (335)..(335): a, c, t, g, unknown or other
  modified_base (339)..(339): a, c, t, g, unknown or other
  modified_base (372)..(372): a, c, t, g, unknown or other
  modified_base (378)..(378): a, c, t, g, unknown or other
  modified_base (448)..(448): a, c, t, g, unknown or other
  modified_base (487)..(500): a, c, t, g, unknown or other
tcagacatacgcgtcacgaccggtgctcgatttagagctcacgtattgggtttgggggccgtccctgggcccagtctgtgttgactcagccaccctcagcgtctgggaccccccgggcagagggtcaccatctcttgttctggaagcgactccaacatcggcgatactcatgtgtactggtaccaacaggtcccagggaccgcccccaaatcctcatgtatgacagtagtgagcggcctnaggggtccctgaccgattctctggctctaagtctggcaccctcggcctccctggacatcagtgcctcggtccaggatgaggctgattatactgtncagnagtgggattacaactgagtgatctagttgggtnttcggnggagccgagctgaccgtcagtcagcccaagcctgccccctcggtcacttctcgtacccaccctctcacgngtactgtctggacgtcggctgggacaacggcgcagtagnnnnnnnnnnnnnn

SEQ ID NO: 404305 - DNA, 621 bp, Homo sapiens
  misc_feature: GZ8MTXP02IW0B9.22.28.C06.1.454.CMB.2.raw
tcagacatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaacatcggcgatactcatgtgtactggtaaccaacaggtccccagggaccggccccccaaaactcctacatgtatgacagtagtgagccggccctcgacggggtcccctggaccgtacttctcgtcggctctaagttctgggccaccgtccggccctcccgtgaccatcacgtcggccctccgggtcccgaggatggacggtctagattattacgtgtagctagactagtaggacttaacgaacgtgagtgtactacgttagggtttgggtaggtttccggggacggtacggggaacccgtaggggtccgttacgggaacccggttccgtaaacgggtaccgtacggaccccgtaaacggggtcctacccggtcccccccg

SEQ ID NO: 404306 - DNA, 753 bp, Homo sapiens
  misc_feature: GZ8MTXP02JQTVN.22.28.C06.1.454.CMB.2.raw
  modified_base (188)..(188): a, c, t, g, unknown or other
  modified_base (210)..(210): a, c, t, g, unknown or other
  modified_base (233)..(233): a, c, t, g, unknown or other
  modified_base (252)..(252): a, c, t, g, unknown or other
  modified_base (266)..(266): a, c, t, g, unknown or other
  modified_base (427)..(427): a, c, t, g, unknown or other
tcagacatacgcgtcacgaccggtgctcgatttagagctcacgtattgggtttggggagcttcagctgtggtagagaagacaggattcaggacaatctccagcatggccggcttccctctcctcctcacccctcctcactcactgtgcagggtcctgggcccagtctgtgttgactcagcccaccctnacgcgtcgtcgggacccccggnaggaggtcaccatctcttgttcnggaagccgtatcccgaaangtcggcaatctacntgtcgtactaggtacccaaacgacggtcccgaaggggaccccgacccccctaaacgtccctcaacgttagttacgtcggaacctaggttaagtcggaacgggtccccggaccctacggtaccgggggttcccctacgggacccgtttacttccgttccggngtacccttacgttaaacggtccgtttggggacccctaaccggttcccggggtccccttcccgggtaggactaaacctcgaacggttccggcccgttacccggtccggaaggtacgtacggagtaccgtagtaactttaagttacgtggttacgctacgcgaaggtcgggtaactttaaccgaccgttgtacgtacggtaacttcgggttaacggtttggggttacggtttaccggggacgggacgggaaccgtacggggactacggacccgttaacggacggttaaccgacgtacccggtaacggcccttacccgggtaccccccg

SEQ ID NO: 404307 - DNA, 513 bp, Homo sapiens
  misc_feature: GZ8MTXP01DAGH7.38.35.D02.1.454.CMB.2.raw
  modified_base (266)..(266): a, c, t, g, unknown or other
  modified_base (268)..(268): a, c, t, g, unknown or other
  modified_base (400)..(400): a, c, t, g, unknown or other
  modified_base (403)..(403): a, c, t, g, unknown or other
  modified_base (407)..(407): a, c, t, g, unknown or other
  modified_base (415)..(415): a, c, t, g, unknown or other
  modified_base (500)..(500): a, c, t, g, unknown or other
  modified_base (504)..(504): a, c, t, g, unknown or other
  modified_base (507)..(513): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaaacagcctgggancngaggacacggctgtctattactgtgcgaaagaccggccctctagtggggtcgggagtttatggtcgtgggggccagggaacccctggcccacgtctctcaacgcctccacaagggcccatccggtctccccngcncccngctcaggngcacctcgagacgcacacgcggcccgtggggctgcccgtggtcaaggctactccacgtgatcgaactgaggcggctggcagggcncaanagnnnnnnn

SEQ ID NO: 404308 - DNA, 556 bp, Homo sapiens
  misc_feature: GZ8MTXP01DJ32Q.38.35.D02.1.454.CMB.2.raw
  modified_base (266)..(266): a, c, t, g, unknown or other
  modified_base (268)..(268): a, c, t, g, unknown or other
  modified_base (420)..(420): a, c, t, g, unknown or other
  modified_base (517)..(517): a, c, t, g, unknown or other
  modified_base (535)..(535): a, c, t, g, unknown or other
  modified_base (549)..(549): a, c, t, g, unknown or other
  modified_base (551)..(556): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctcagagacaattccaaagagcacactctatttgacaaatgaaacagcctgggancngaggacacggctgtctattactgtgacgaaaacgacccggccctctagtgggggtacgggagtttagtgtcgtgggggccaggggaaccctggcccacgtctcctcaacgcctccgaaccaacgggcccatccggtccttcccccgtggccnccctgcctccgaggacgccacccgtccgagacgccacgaggtcccggccccgttgggggccttgcccgtggtaccaaacggtctaaccgttccagtnactcgaactggagcgggntggcaggcacgaangnnnnnn

SEQ ID NO: 404309 - DNA, 661 bp, Homo sapiens
  misc_feature: GZ8MTXP01D6Y4F.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctgggtggagtcgtgggggagtcgtggtccaggccgtgggggtccctgagctctcctgtgcagcctctggatcaacttacaaaaattgtgggatgcacgtcgggtcccgccaggcctccgaggcgaagggggctgggaggtgggtgacaactatactcatagtagtagttaagggttaaagttttaagacttaagtggaccggtactaccgggtaggaaacgggccgtattccaaccatcctaccaagacgaactaactaccaaagacgacaacctacgttacttaatttacgaactaaaagtacgaaactacggaccgtaggggaacgtccgtaggaacgggaaccgtacggttcttacggttacttaagttaaccgttggttacggaaccggtaaaaccggtaaccccggtcccgttacgtaggttacgggggttaacggggttaacgggtttaagg

SEQ ID NO: 404310 - DNA, 565 bp, Homo sapiens
  misc_feature: GZ8MTXP01AITBJ.38.35.D02.1.454.CMB.2.raw
  modified_base (264)..(264): a, c, t, g, unknown or other
  modified_base (552)..(552): a, c, t, g, unknown or other
  modified_base (557)..(557): a, c, t, g, unknown or other
  modified_base (559)..(565): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctggganctgaggacacggctgtctattactgtgcgaaagaccggccctcgtatgggtcgggagttatgtcgtggggccagggaccctggccacgtctccctcaacgccctccaccaaacgggccccagtccgggtccttccccccgtgggcccgccctgcctccacgggacgccaccgtccgacgacgccacgacgccgggccccgtggggccttcggcccgtgggtccaagggaccttaccgttcccaacggttcgactccggaacctggacggccggggctgggcaagggcncaagngnnnnnnn

SEQ ID NO: 404311 - DNA, 535 bp, Homo sapiens
  misc_feature: GZ8MTXP01A11PF.38.35.D02.1.454.CMB.2.raw
  modified_base (263)..(263): a, c, t, g, unknown or other
  modified_base (363)..(363): a, c, t, g, unknown or other
  modified_base (413)..(413): a, c, t, g, unknown or other
  modified_base (441)..(441): a, c, t, g, unknown or other
  modified_base (446)..(446): a, c, t, g, unknown or other
  modified_base (491)..(491): a, c, t, g, unknown or other
  modified_base (521)..(521): a, c, t, g, unknown or other
  modified_base (528)..(532): a, c, t, g, unknown or other
  modified_base (534)..(535): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctattgcaaatgaacagcctggganctgaggacacggctgtctatactgtgcgaaagaccggccctctagtggggtcgggagtttatcggtcgtgggggccaggggaaccctggccacgtctccncaacgccctccaccgaagggcccctagtccggtccttcccccgtggcccncccgtgcctcgaggcgccactccgagcncaacnggccggccgtgggcctcgccgtggtcaaggcctacttccacggtnacgtcgaactggagcgggctgggcagggcncaagtgnnnnngnn

SEQ ID NO: 404312 - DNA, 598 bp, Homo sapiens
  misc_feature: GZ8MTXP01D79C8.38.35.D02.1.454.CMB.2.raw
  modified_base (307)..(307): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactatcctgtgcagcctctggatcaacttacaaaattatgggatgcacgtgggtccnccaggcctccgaggcgaagggggctgggagtgggtgcaacgtatactcatatgataaggaaagttttaagacttaatggacggactccggtaggaacgggccgtattcacatctaccagtacgacaacttaccaagacgactaacacttacttaatttcgaactaaagtacgaaacacggcccgtaggggtaacgcgtagagggaacgacggctgttaccgtattacgttgttcgacgaaacggacccgggtcccctaggtacgttccggggtaacgggttaagtttaagg

SEQ ID NO: 404313 - DNA, 520 bp, Homo sapiens
  misc_feature: GZ8MTXP01AWTHF.38.35.D02.1.454.CMB.2.raw
  modified_base (264)..(264): a, c, t, g, unknown or other
  modified_base (266)..(266): a, c, t, g, unknown or other
  modified_base (443)..(443): a, c, t, g, unknown or other
  modified_base (514)..(520): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggancngaggacacggctgtctattactgtgcgaaagaaccggcctctagtgggggtcgggagtttagtgtcgtgggggccaggggaaccctggccacgtctcctcaacgccctcaccaagggccccatccggtccttcccccgtggccgccctgcctccgaggacgcacctccgagcgcacngccggccctggggctgcctggcaaggctactcacgtgatcgaactgagcgggctgggcaggcgttcaatgnnnnnnn

SEQ ID NO: 404314 - DNA, 548 bp, Homo sapiens
  misc_feature: GZ8MTXP01B4EC3.38.35.D02.1.454.CMB.2.raw
  modified_base (261)..(261): a, c, t, g, unknown or other
  modified_base (403)..(403): a, c, t, g, unknown or other
  modified_base (409)..(409): a, c, t, g, unknown or other
  modified_base (417)..(417): a, c, t, g, unknown or other
  modified_base (542)..(548): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggatcgtgaaggcgattcaccatctcagagacaattccaagagcacactctatttgcaaatgaacagcctgggagcngaggacacggctgtctattaactgtgcgaaaagaacccggcctctaagtggggtcggggagtttatgtcgtgggggccaggggaaccctggccacgtctcctcaagccctcaccaaagggccccagtccggtcttcccccgnggcccnccctcgcnccgacgacgacaccgaccgacgacgcacgacgccggccgggtcggcgtcgcgtcgtcgaacgacgtacctacctacgtacgtacgtcgaacgtcgcggcgggcgtcggcgacggcgacgaagagnnnnnnn

SEQ ID NO: 404315 - DNA, 733 bp, Homo sapiens
  misc_feature: GZ8MTXP01BK7HX.38.35.D02.1.454.CMB.2.raw
tcagtcgatcacgtcacgaccggtgctcgatttagcacacgatagttgggtttggggagctctgggagaggagtccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggatcaacttacaaaattgtgggatgcacgtcgggtcccgccaggcctccgaggcgaagggggctgggaggtgggtggacaaacttagtactcaatagtagtaattaagggttaaaagtttttaagaacgtttagtacgggaccggtaccgttacccgggtagggaaacggggtcccgtaagttacccaaccctacttcccgtacccgaacggaacgtaacctaaacgttacccgaaagtacgaccaacctaaccgttactttaagttttacgaacctaaaattacggaaacacggtacccgttaggggacgtaccgttacgggacgggtaaccgacgggttacgttacggttaccttaacgtttacgttacggttacggttacccggaaaaacgggtaaccccgggtcccccgttaaggttacgggttacggggggttaaccggggttaacggttttaacggg

SEQ ID NO: 404316 - DNA, 638 bp, Homo sapiens
  misc_feature: GZ8MTXP01DIJ91.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggatcaaacttacaaaaattatgggatgcacgtgggtcccgccgaggcctccgaggcgaagggggctgggaggtgggtgacaatatactcatatgataaggtaaattttaagactagtcggacggtacgtccggtaggaacgggccgtattccacctatcctaccgaagacgactaacttaccaaagacgacctaactacttacttaagtttacgaacctaaagtcgaaacgacggacccgtaggggacgtcgtagggacggaaccgacggttccttggttaccttagtttaccgttaggttcgaaccggtaaacggaaccccggtcccgttacgtaggttcgggggtaacgggttaagtttaacgg

SEQ ID NO: 404317 - DNA, 589 bp, Homo sapiens
  misc_feature: GZ8MTXP01CKQC9.38.35.D02.1.454.CMB.2.raw
  modified_base (262)..(262): a, c, t, g, unknown or other
  modified_base (264)..(264): a, c, t, g, unknown or other
  modified_base (560)..(560): a, c, t, g, unknown or other
  modified_base (581)..(581): a, c, t, g, unknown or other
  modified_base (584)..(589): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaaggccattcaccatctcagagacaattccaagagcacactctatttgacaaatgaacagcctgggancngagacacggctgtctattactgtgacgaaacgaacccggcctacgtagtgggggtcgggggtatttagtgtcgtggggaccgacgggaacccctcgggccctacggtcctccctacaacgccctccgaacccgaacgggccctacgtccggtcccttccccccgtggcccgtccctcgcctccgacgggacgcctacccgcgacgcgacacgacgccggcccggtgggcctcgcccgtggtccaaacggtaccttaaccgtccgaacgttgacttcggaactgggacggccgggcncgggacacggggcacggtaangcnnnnnn

SEQ ID NO: 404318 - DNA, 572 bp, Homo sapiens
  misc_feature: GZ8MTXP01A3NRH.38.35.D02.1.454.CMB.2.raw
  modified_base (265)..(265): a, c, t, g, unknown or other
  modified_base (267)..(267): a, c, t, g, unknown or other
  modified_base (562)..(562): a, c, t, g, unknown or other
  modified_base (564)..(564): a, c, t, g, unknown or other
  modified_base (566)..(572): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctgggancngaggacacggctgtctattactgtgacgaaagacccggccctctagtggggtcggggagtttatgtcgtgggggccacggggaaccctcggcccaccgtctccctcaacgccctccaccgaacgggccccagtccggtccttcccccgtggcccgccctcgcctccgaggacgccaccctccgagacgcacgacgcccggcccggtggggcctcggccgtagggtaacggccttaccgttcccgacgttgacttccggacgtgcggcggggtcttgggacgaacgggccgacagngngnnnnnnn

SEQ ID NO: 404319 - DNA, 618 bp, Homo sapiens
  misc_feature: GZ8MTXP01ACW8L.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctgggtggagtcgtgggggagtcgtggtccagccgtgggggtccctgagactctcctgtgcagcctctggatcaacttacaaaaattgtagggatgcacgtgggtcccgccaggcctccgaggcgaagggggctgggaggtgggtcgactaaactagtactcatatgaagttaagggtaaagttttaagacttagtcggaccggtacgtccggtaggaaacgggccgtacttaccgacctactactacccagacgaacaacttaccgaaagacgacaaccacgttacttaagtttacgaactaaatacgaaacaggacccgtaggggacgcgtaggacggaaccgacggctgttactattacttgttcgacgaaacgacccgtaacctcgtagttacggggtcgggttaagttgg

SEQ ID NO: 404320 - DNA, 556 bp, Homo sapiens
  misc_feature: GZ8MTXP01DLU3J.38.35.D02.1.454.CMB.2.raw
  modified_base (311)..(311): a, c, t, g, unknown or other
  modified_base (477)..(477): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaaacttacaaaaaattgtagggatgcactgggtccnccaggctccaggcaagggggctgggagtggggtgacaaactatatcatatgatagggtaaattttaagactatgcgtaactccggtagaaacgggcattcaccatctacagacgacaatccaaagagcaacactactatttagacaaatgaaacagaccgtgggancgagaggaacacggctgttactattacttgttcgaacgaaacgaacccggtccctagtagttggggtaacgggaagttg

SEQ ID NO: 404321 - DNA, 631 bp, Homo sapiens
  misc_feature: GZ8MTXP01DA3Q8.38.35.D02.1.454.CMB.2.raw
  modified_base (487)..(487): a, c, t, g, unknown or other
  modified_base (516)..(516): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctggagactctcctgtgcagcctctggatcaacttcaaaaattatgggatgcacgtgggtccgccaggcctccgaggcgaaggggctggaggtgggtgacaactatactcatatgataagggtaaagttttaagacttaagtaggacggtactccggtagaaacggggtcccaagtttccaaccatacctacccgaaggacaactaatacccaaagacacaacctacgtacttagtttanaactaaatacgaacagtaccgtgggtacncgtaggaacggaacgtacggttcgttcgttacttaacgttcgttaggttacggaaccggaaaaccggtacccgtcccgttacggtagggttacgggggtaacgggttaaggttgg

SEQ ID NO: 404322 - DNA, 629 bp, Homo sapiens
  misc_feature: GZ8MTXP01DAFUY.38.35.D02.1.454.CMB.2.raw
  modified_base (185)..(185): a, c, t, g, unknown or other
  modified_base (296)..(296): a, c, t, g, unknown or other
  modified_base (315)..(315): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtntccagtgtcagatgcagcgtgggtggagttcgtgggggagtcgtggtccaggtccgtggggggtccctgacgtactctcctgtgcagcctctggatcaacttcaaaaattntgggatgctacgtggtccncaggctccgaggcaagggggctgggagtgggtgcaacgtatatcatatgataacgggtaaattttaagcttagtcgacgactcggtagaacgggcattcaccatctaccaagtacgaacaactccaaagcgaacacacgttacttagtttaacaactaaagtacgaacgtacggtaccgtagggtacgtcgtaaggaacggaacgtacggttcttacgttacgttaacgtttacgttacggttacgaaaccggtaaaccggtacccggtccgttacggttacggggttacgggggttaacgggttaagtttggg

SEQ ID NO: 404323 - DNA, 555 bp, Homo sapiens
  misc_feature: GZ8MTXP01CLSB1.38.35.D02.1.454.CMB.2.raw
  modified_base (216)..(216): a, c, t, g, unknown or other
  modified_base (262)..(262): a, c, t, g, unknown or other
  modified_base (264)..(264): a, c, t, g, unknown or other
  modified_base (333)..(333): a, c, t, g, unknown or other
  modified_base (424)..(424): a, c, t, g, unknown or other
  modified_base (515)..(515): a, c, t, g, unknown or other
  modified_base (518)..(518): a, c, t, g, unknown or other
  modified_base (545)..(545): a, c, t, g, unknown or other
  modified_base (548)..(555): a, c, t, g, unknown or other
tcagtcgatcacgtcacgaccggtgctcgatttagcacacgatagttgggtttgggagactctcctgtgcagcctctggattcaacttcaaaaaattatgggatgcactgggtccgccaggctccaggcaaggggctggagtgggtggcaactatatcatatgatggaagttttaaagactatgcggactcgtgaaggccattcaccatctcaganacaattccaagagcacactctatttgacaaatgaacagcctgggancngaggacacggctgtctattactgtgacgaaaagaaccggccctactagtgggggtcggggtaatttagngtcgtggggaccaaggggaaccctcggaccaccgtctcctcaacgccctccaaccgaaagggccccaacgtccgggtccctttccccccgnggcccgtccctcgcctaccgaggaccgaccaccgtacgacgacgacacgacgccggccggtcggctcgcgtgtacgaacgactactcacgngcncgaactggcggcggcgcggacgagcanaannnnnnnn

SEQ ID NO: 404324 - DNA, 552 bp, Homo sapiens
  misc_feature: GZ8MTXP01AG4JR.38.35.D02.1.454.CMB.2.raw
  modified_base (265)..(265): a, c, t, g, unknown or other
  modified_base (267)..(267): a, c, t, g, unknown or other
  modified_base (532)..(532): a, c, t, g, unknown or other
  modified_base (542)..(542): a, c, t, g, unknown or other
  modified_base (544)..(544): a, c, t, g, unknown or other
  modified_base (546)..(552): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctgggancngaggacacggctgtctattactgtgacgaaagaccggcctcgtagtgggtcgggatttatggtacgtgggggccaggggaccctggcccacgtctccctcaacgccctccaccgaaggggccccagtccgggtccttcccccgtgggcccgcccctagcctccgaggacgccacccgtcgacgacgcctacgacggccggcccggtgggcctggccctggtaccaaggccttacgtccagtgactcggaactgacggcggttcgnggcagggcangngnnnnnnn

SEQ ID NO: 404325 - DNA, 611 bp, Homo sapiens
  misc_feature: GZ8MTXP01DN3LG.38.35.D02.1.454.CMB.2.raw
  modified_base (289)..(289): a, c, t, g, unknown or other
  modified_base (429)..(429): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggatcaacttacaaaaattntgggatgcacgtgggtccgccaggcctccgaggcgaagggggctgggagtgggtggacaactatatcatatgataagggtaaagttttaagactagtggacgactccggtaggaacgggccgtattcacatctaccaganacaataccaagacacacactactatttgactaaatgaaacagaccgtgggacgcgtaggacggaacgacgggttcttacggttactttaaacgttcgttaggttcggaacggtaaaacgggtaaaccccggtccccgttaccgtaagggttcgggggtaaccgggggttaagttttaacggg

SEQ ID NO: 404326 - DNA, 544 bp, Homo sapiens
  misc_feature: GZ8MTXP01DOB1T.38.35.D02.1.454.CMB.2.raw
  modified_base (266)..(266): a, c, t, g, unknown or other
  modified_base (337)..(337): a, c, t, g, unknown or other
  modified_base (456)..(456): a, c, t, g, unknown or other
  modified_base (462)..(462): a, c, t, g, unknown or other
  modified_base (506)..(506): a, c, t, g, unknown or other
  modified_base (537)..(544): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaaacagcctggganctgaggacacggctgtctattactgtagacgaaacgaaccggcccctcgtagtgggggtcggggatttagngtcgtgggccagggaaccctcggccacgtctcctcaacgccctccaaccgaacgggccccatcccgggtccttcccccgtggccgtcccctggcctccgaggacgccaccctcgagacnccaacncggtccggccgtggggcttcgccctggtccaaggctactcagtnactcgaactgagcggctggcaggcgcaagtnnnnnnnn

SEQ ID NO: 404327 - DNA, 767 bp, Homo sapiens
  misc_feature: GZ8MTXP01ALMYD.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccgagtgtcagatgcgagtcgtgggtggtaggtcgggtagggggtacgttcggtcggtccgacggtcccgggttcggggggtccctaggacgtaccgttcctccgtggtcgcgacgtccctcgtggtactacctaaacttaactaaaattagtagggtatcgacgtacggtcgggtcccgccgacggtcctaccggaggacggaagggggtcgtaggggagggtgggtcggaactaaacttatactactatagtagtaagttaaagggttaaagtttaagactagtacgggtaccggtacgttccggtaagggaaccggggtcctaacgttacccgaacctacgttccgtaaccgaacgtaacgtaacttaaacgtacccgaaagacgacctaactactttacgttaagttacgaaactaaacgtacgaaacgtaccggtaccggtagggactacgtaggaacggtaacggtaccgttgttacgttacgtttacgtaacgttcggttacggaaccgtaaaaccggtacccccggtccgtttaggtacggggttcgggggttaacgggttaagttttccggg

SEQ ID NO: 404328 - DNA, 614 bp, Homo sapiens
  misc_feature: GZ8MTXP01CSN1C.38.35.D02.1.454.CMB.2.raw
  modified_base (433)..(433): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtgcagcctctggatcaaacttacaaaaattgtgggatgcacgtcgggtcccgccaggcctccgaggcgaagggggctgggaggtgggtggacaactagtactcatagtagaagttaagggtaaagttttaagactaagtcggacggtactccggtaggaacggccgattcacntccacagacgaacatccaagcacacatacttattgactaaatcgaaacagaccgtagggacgcgtaggaacggaacgacgggcttacggttccttaagtttaccgttaggttcgaaccggtaaaacggtaccccggtcccgttaccggtaaggttcgggggttcggggttaagtttaacgg

SEQ ID NO: 404329 - DNA, 551 bp, Homo sapiens
  misc_feature: GZ8MTXP01CW27W.38.35.D02.1.454.CMB.2.raw
  modified_base (261)..(261): a, c, t, g, unknown or other
  modified_base (263)..(263): a, c, t, g, unknown or other
  modified_base (325)..(325): a, c, t, g, unknown or other
  modified_base (416)..(416): a, c, t, g, unknown or other
  modified_base (543)..(543): a, c, t, g, unknown or other
  modified_base (545)..(551): a, c, t, g, unknown or other
tcagtcgatcacgtcacgaccggtgctcgatttagcacacgatagttgggtttgggagactctcctgtgcagcctctggattcaacttcaaaattatgggatgcactgggtccgccaggctccaggcaaggggctggagtgggtggcaactatatcatatgatggaagttttaaagactatgcggactccgtgaaggccgattcaccatctccagagacaattccaagagcacactctattgcaaatgaacagcctgggancngaggacacggctgtctattactgtgacgaaagaccggccctctagtggggtcgggagtttanggtctgggggaccaggggaacccctgggcccaccgtctccctcaacgccctccgacccaaacggggccccagtcccggtccttccccccgngggcccgtcccctcgcctcccgaggacgccaccctccgagacgccacacgccggcccgtggggcctgcccgtggtacaggacctacgtccacgtgatcgaactgcgcggctgggcaaggcgctaagngnnnnnnn

SEQ ID NO: 404330 - DNA, 596 bp, Homo sapiens
  misc_feature: GZ8MTXP01BA95D.38.35.D02.1.454.CMB.2.raw
  modified_base (266)..(266): a, c, t, g, unknown or other
  modified_base (268)..(268): a, c, t, g, unknown or other
  modified_base (310)..(310): a, c, t, g, unknown or other
  modified_base (588)..(588): a, c, t, g, unknown or other
  modified_base (590)..(593): a, c, t, g, unknown or other
  modified_base (595)..(596): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaaacagcctgggancngaggacacggctgtctattactgtgacgaaagaccggccctntagtggggtcgggatttatgtcgtgggccagggaccctggccacgtctcctcaacgccctccaccgaacgggcccagtccggtcccttcccccgtggcccgtccctcgcctccgaggacgcccaccgtccgacgacgccacgacggcccggcccgggtcggggcctcggcccgttacggggtaccgaaacgggtacccttacccgtttcccgacggttcgaacgtccggaaccgtggaccgggcggggcgtacgggaccgaagggccgacgaataggngnnnngnn

SEQ ID NO: 404331 - DNA, 617 bp, Homo sapiens
  misc_feature: GZ8MTXP01ANF4G.38.35.D02.1.454.CMB.2.raw
  modified_base (263)..(263): a, c, t, g, unknown or other
  modified_base (274)..(274): a, c, t, g, unknown or other
  modified_base (578)..(578): a, c, t, g, unknown or other
  modified_base (581)..(581): a, c, t, g, unknown or other
  modified_base (610)..(617): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagtttaagactatgcgactccgtgaaggccgattcaccatctccagagacaattaccaagagcacactctatttgcaaatgaacagccgtggagcngaggacgacgntgtctattactgtgacggaaacgaacccggccctactagtgggggtcgggagtttatcggtcgtgggggcccaaggggaaccccgtcggcccaccgtctcccgtcaaacggtcccctcccgaaacccgaaacggggccctacgtccgggttcccttccccccgtcgggcccgccccttcggcctaccgacggaacgcccaacccgttccggagacgtccaaaccgcggtcccgggccccgtggggcctcgtaccccgtggtaccgaaacggtcctaaccttccccgaggttgactcgaaccggnggnggccggcgtacggacgacggcgacaagtnnnnnnnn

SEQ ID NO: 404332 - DNA, 658 bp, Homo sapiens
  misc_feature: GZ8MTXP01D3CLX.38.35.D02.1.454.CMB.2.raw
  modified_base (351)..(351): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgacgactctcctgtgcagcctctggatcaacttacaaaaattagtgggatgctacgtcgggtccgccgaggcctccgaggcgaagggggctgggaggtgggnggcaaacgtatactcatagtgtaagtaagggtaaagttttaagacttaagtcggacggtacgtccggtagggaacgggccgtattaccaccgtactcgaccctaagacgaactaacttaccgaaagacacaacctacgttacttaagtttacgaactaaagtacgaaacgacgtacccgtaggggactcggtaggaacgggaaccacgggttcgttcgttacttaacgttacttcggttcgaaccggaaacgggtaaccccgcccgttacgtaggggttcgggggtaacggggttaaggtttaacgg

SEQ ID NO: 404333 - DNA, 684 bp, Homo sapiens
  misc_feature: GZ8MTXP01C15L2.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgacgactctcctgtgcagcctctggatcaacttacaaaaattgtgggatgcacgtgggtccgccaggcctccgaggcgaagggggctgggaggtgggtggacaactatactcgattagtgtaataagggtaaagtttttaagacttaagtgtacggactccggtaggaacgggtccgtattaccgacctagtcctacccgaagacgaactaaacgttacccaaagacgaccaactacgttaccttaatttagacctaaaagtacgaaactacgacccgtagggaacgtccgtaggaacgggaaccgtaccgggttacttcgttaccgtttaaagtttcgttaacggttcggttaaacccggaaaaaccgggaccccgggtaacccctttaacggtacgggttacgggggttaaccgggggttaacgttttaacggg

SEQ ID NO: 404334 - DNA, 706 bp, Homo sapiens
  misc_feature: GZ8MTXP01AHU3F.38.35.D02.1.454.CMB.2.raw
  modified_base (368)..(368): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctgggtggagtcgtgggggagtcggtcggtccaggccggtcggggggtccctggacgtactctcctgtgcacgcctcgtggtataccaacttaactaaaaattgtagggatgctacggtcgggtcccgccgaggcctccgaggcgaaggggcgtgggaggtgggngactaactagtatcatagtgtagttaagggttaaagttttaagactagtgtaccggtacgtccggtaggaacgggccgtattaccgactactaccgtaccgaagaaccgtaactaaacgttaccgaaagacgaacctacctaaccttatttaacgtttacggaaacctaaaagtcgaaaccgtacggtacccgggtaggggactaccggtagggaaccgggtaacgaacggggttctttacggttacttaacgttacgttcggttacggaaccgtaaacccgggaaccccgtccccgttaggtacgggttcgggggtaaccgggttaagtttaacggg

SEQ ID NO: 404335 - DNA, 582 bp, Homo sapiens
  misc_feature: GZ8MTXP01BYKZ1.38.35.D02.1.454.CMB.2.raw
  modified_base (254)..(254): a, c, t, g, unknown or other
  modified_base (263)..(263): a, c, t, g, unknown or other
  modified_base (265)..(265): a, c, t, g, unknown or other
  modified_base (286)..(286): a, c, t, g, unknown or other
  modified_base (307)..(307): a, c, t, g, unknown or other
  modified_base (543)..(543): a, c, t, g, unknown or other
  modified_base (571)..(571): a, c, t, g, unknown or other
  modified_base (573)..(573): a, c, t, g, unknown or other
  modified_base (575)..(575): a, c, t, g, unknown or other
  modified_base (577)..(578): a, c, t, g, unknown or other
  modified_base (580)..(580): a, c, t, g, unknown or other
  modified_base (582)..(582): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagatatgcggactccgtgaagggccgattcaccatctccagagacaattccaagagcacactctattgacaaatgaacngcctgggancngagacacggctgtctattacngtgacgaaagacccggccctntagtggggcggtatttagtggtcgtgggccagggtacccctggccctaccgtctcctcgaacgccctccgaccaacgggccccagtccgggtcccttcccccgtgcccgtccctgcctccgaggacgtccacccgtcgacgacgcaccgagcccggccggtcggggccttcgccgtggtaccgaaagggtaccttaccttccgacgttcgaacgtccgaacgtggacgggccgggngtcgggcgaagggccgactaagttaggngngngnngngn

SEQ ID NO: 404336 - DNA, 650 bp, Homo sapiens
  misc_feature: GZ8MTXP01ANFD4.38.35.D02.1.454.CMB.2.raw
  modified_base (292)..(292): a, c, t, g, unknown or other
  modified_base (311)..(311): a, c, t, g, unknown or other
  modified_base (474)..(474): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggatcaaacttacaaaaattngggatgcacgtgggtcccncgaggctccgaggccgaagggggctggacggtgggtggacaaactagtatacgattatgaattaagggtaaagtttttaagactaagtcggaccggtactccggtagaaacgggtcccgtattccacctatacctaccgaagacgaactaaattacccaaagngaccaacacgttacttaatttacgaactaaaatcgaaacaggcccgttagggacgtaccgtaggaacggccgaacgggttccttaggttacttaaacgttacgttaggttacgaacggaaaccgtaacccgggtccctacgttaagggttcgggggtaacgggttaagtttaaggg

SEQ ID NO: 404337 - DNA, 687 bp, Homo sapiens
  misc_feature: GZ8MTXP01EVJVK.38.35.D02.1.454.CMB.2.raw
  modified_base (264)..(264): a, c, t, g, unknown or other
  modified_base (268)..(268): a, c, t, g, unknown or other
  modified_base (286)..(286): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccagccggtgggggtccctgagctctcctgtgcngctntgatcaactacaaaattntgggatgctacgtcgggtcccgccgaggcctaccgaggaccgaagggggcgtagggaggtggggtacgactaaacgttatactcaattatagtaagttaaagggttaaagttttaagacttagtcggaccggtaccgtacgggtaggaacgggtcccgtaattaccgaacccatcctacccgaaaggaacgtaactaaacgttacccgaaagacgaactaacctaacgttacttaatttacgaacctaaaagtcgaaacgtcggacccgtaggacgtcgtaggacggaaccgtacggttactcgttactaacgttacgttggttacggaacccggtaaaaccggtaaccccggtcccgttacggtacggggttacgggggtaacggggttaagtttaacgg

SEQ ID NO: 404338 - DNA, 569 bp, Homo sapiens
  misc_feature: GZ8MTXP01AVQ3H.38.35.D02.1.454.CMB.2.raw
  modified_base (261)..(261): a, c, t, g, unknown or other
  modified_base (270)..(270): a, c, t, g, unknown or other
  modified_base (294)..(294): a, c, t, g, unknown or other
  modified_base (315)..(315): a, c, t, g, unknown or other
  modified_base (374)..(374): a, c, t, g, unknown or other
  modified_base (418)..(418): a, c, t, g, unknown or other
  modified_base (424)..(424): a, c, t, g, unknown or other
  modified_base (522)..(522): a, c, t, g, unknown or other
  modified_base (546)..(546): a, c, t, g, unknown or other
  modified_base (563)..(565): a, c, t, g, unknown or other
  modified_base (567)..(567): a, c, t, g, unknown or other
  modified_base (569)..(569): a, c, t, g, unknown or other
tcagtcgatcacgtcacgaccggtgctcgatttagcacacgatagttgggtttgggggtccctgagactctcctgtgcagcctctggattcaacttcaaaaattatgggatgcactgggtccgccaggctccaggcaaggggctggagtgggtggcaactatatcatatgatggaagttttaaagctatgcggactccgtgaaggccattcaccatctccagagacaattccaagagcacactctatttgacaaatgaacngcctggganctgaggacacggctgtctattacngtgacgaaacgacccggcctntagtggggtcgggattagtgtcgtggggccacgggaccctggccctaccgtctccctcncgccctaccaccgacgggcccctagtccgggtcccttcccccgnggcccncccgtgcctcgacggcacccgaccgacgacgcgacaccggtcggggccggtcccgtgggcctcggccgtcggaccaacggtcctaccgtccgacggtnaacgtcgacgtcggcggcggtcgnggcgacggccagaatgnnngngn

SEQ ID NO: 404339 - DNA, 549 bp, Homo sapiens
  misc_feature: GZ8MTXP01AMAON.38.35.D02.1.454.CMB.2.raw
  modified_base (262)..(262): a, c, t, g, unknown or other
  modified_base (288)..(288): a, c, t, g, unknown or other
  modified_base (407)..(407): a, c, t, g, unknown or other
  modified_base (439)..(439): a, c, t, g, unknown or other
  modified_base (445)..(445): a, c, t, g, unknown or other
  modified_base (455)..(455): a, c, t, g, unknown or other
  modified_base (463)..(463): a, c, t, g, unknown or other
  modified_base (495)..(495): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctctgtgcngcctctggatcaacttcaaaaaattntgggatgcacgtgggtccgccaggctccgaggcgaagggggctggggagtggggtggacaacgtatactcgatatgatagggaattttaagactatgcgactcgtgaggcatcacatcncagagacaatccaagagcacactctagtttanactaangaacagacgnggacgagnggacgaacgcggttctgttacgtacgttacgngttacgaccggaaacggcccgtcctagtacggttcggggtaacgggttgttaag

SEQ ID NO: 404340 - DNA, 551 bp, Homo sapiens
  misc_feature: GZ8MTXP01BX16K.38.35.D02.1.454.CMB.2.raw
  modified_base (378)..(378): a, c, t, g, unknown or other
  modified_base (548)..(551): a, c, t, g, unknown or other
tcagtcgatcacgtcacgaccggtgctcgatttagcacacgatagttgggtttggggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgacgaaagaccggcctctagtggggtcgggtagttatgtcgtggggccacggggacccctggcccaccgtcctccctcncggccctccgacccgaacggggccccagtcccggtccttccccctggcccgccctgcctccaggcgccacctccgagacgtcacgagggtcggcccgtgggctgccctggtcaacggtctacgttccacgtgaatcggactgacgcgggcttgggccaggcgcaagtgcnnnn

SEQ ID NO: 404341 - DNA, 608 bp, Homo sapiens
  misc_feature: GZ8MTXP01B8Q2N.38.35.D02.1.454.CMB.2.raw
  modified_base (290)..(290): a, c, t, g, unknown or other
  modified_base (309)..(309): a, c, t, g, unknown or other
  modified_base (375)..(375): a, c, t, g, unknown or other
tcagtcgatcacgtcacgaccggtgctcgatttagcacacgataggttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggatcaacttcaaaattntgggatggcactgggtccnccaggctccaggcaagggggctggagtgggtgcaactatacgtcatatgataggaatttaagctangcgactcgtgacgggccagttcacatctaccagagacaacttccaaagcgacactacgtactatttagacctaaatcggaaacaggtcccgtaggggtaacgcgtacggaacggggtaaccccgtcgttacgttccgttaacgttacgttacgttacgttacggaaaaccggtaaccggtccccgtaaccttacggtacggggttacggggtaaccgggttaagtttccgggg

SEQ ID NO: 404342 - DNA, 680 bp, Homo sapiens
  misc_feature: GZ8MTXP01CAROE.38.35.D02.1.454.CMB.2.raw
  modified_base (394)..(394): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctcgtggatcaacttacaaaaattgtgggatgctagtcgggtccgccaggcctccgaggcgaagggggctgggaggtggggtgacaacgtatactcatatgataagggtaaagttttaagacttagnggcgtactcggtagacgggcgtattccgactactcctacgaagaacgacaacttaccgaagacgactaacctacgttacttaagtttcgaactaaagtacgaaaccgacggtacccggtaggggacgccggtagggaacgggtaaccgacggggttaccttacggttaccgttaaacgtttacccggttaggttaccgggaaacccgggtaaaaacgggtacccccggtaacccgttacccggtaggggttaccgggggttaaccgggggttaacgtttaacgggg

SEQ ID NO: 404343 - DNA, 688 bp, Homo sapiens
  misc_feature: GZ8MTXP01EMRWW.38.35.D02.1.454.CMB.2.raw
  modified_base (271)..(271): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagcgtggtggagtcgtgggggagtcgtggtccgaggtccggtggggggtccctggacgactctcctgtgcngcctcgtggatacaacttacaaaattagtagggatgctacgtcgggtccgccgaggcctccgaggcgaagggggctgggaggtgggtgactaaactatactacatagtgtaagtaaaggttaaagttttaagacttagtacgggacggtaccgtacgggtaggaacgggtccgtaagttaccaccgtactcctacgaagaacgtaactaacgtaccgaaacgacgactaacctacttaacttaagtttacgaaactaaagtacgaaactacggacccggtagggacgtaccgtaggaacggaaccgtcggttaccttggttaaccttagtttacttagggttcgaaacccggaaaccggttaaccccgggtcccttaacgggtacggttaccgggggttaacgggttaagtttcggg

SEQ ID NO: 404344 - DNA, 635 bp, Homo sapiens
  misc_feature: GZ8MTXP01EF6OQ.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccagccgtgggggtccctgacgtctctcctgtgcagcctctggtatacaaacttactaaaaaattgtgggatgctacgtcgggtccgccgaggcctaccgaggcgaagggggctggaggtgggtgacaaacgtatactcatatgtaagtaacgggtaaattttaagacttagtcgaccggtactccgggtagaacgggtccgacttccaacctattccaccaagactaactaactaccaaagacacaacctacgttacttaatttacgaactaaaagtacgaaaccgagacccggtaggggaacgtccgtagggaacggaacgtacgggttctgttactagttacgttggttgaaccgaaacggacccgtccgtacgtagggttcggggtcgggttaagtttaag

SEQ ID NO: 404345 - DNA, 710 bp, Homo sapiens
  misc_feature: GZ8MTXP01A0QJC.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccgagccggtggggggtccctggacgtacctctccgtgtcgcacgtcctgtggtactaccaaacttacaaaaagttgtagggatgctacgtcgggtccccgaccgacgggcctaccgagggacggaacgggggtcgtagggacgggtgggtagactaaacgtatacgtcattagtagaagttaaaggttaaagttttaagacttagtcggacgtacgtcggagaacgggtcagttaccacgtactacctacgaagacgtaactaacttaccaaacgtaacgacctaaccgtacttacttaagtttacgaacctaaagtacgaaacgtacggaccggtagggacgtacggtacggaacggtaaccgtaacgggttcttacgttaccgtttaagttaacgttacggttacggaaaccggtaaaaccggtacccggtaacccgttacggtacgggttacggggtaacgggttaagtttaacggg

SEQ ID NO: 404346 - DNA, 512 bp, Homo sapiens
  misc_feature: GZ8MTXP01DIU01.38.35.D02.1.454.CMB.2.raw
  modified_base (268)..(268): a, c, t, g, unknown or other
  modified_base (313)..(313): a, c, t, g, unknown or other
  modified_base (333)..(333): a, c, t, g, unknown or other
  modified_base (404)..(404): a, c, t, g, unknown or other
  modified_base (408)..(408): a, c, t, g, unknown or other
  modified_base (412)..(412): a, c, t, g, unknown or other
  modified_base (414)..(414): a, c, t, g, unknown or other
  modified_base (416)..(416): a, c, t, g, unknown or other
  modified_base (423)..(423): a, c, t, g, unknown or other
  modified_base (426)..(426): a, c, t, g, unknown or other
  modified_base (474)..(474): a, c, t, g, unknown or other
  modified_base (482)..(482): a, c, t, g, unknown or other
  modified_base (506)..(512): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaaagagcacactctatttgacaaatgaacagcctgggagcngaggacacggctgtctattactgtgacgaaaagaaccggcccctntaatggggtcgggagtttangtctggggccaggggaacccctggccacgtctcctcaagccctccacaaacgggcccatcgtcttccccgngccncctncncngagcacncgngagcacagcgccggcggcgtcgcgtcgtcgacgactactcctacgtgncgaactgnggcggcgtgcgacggcgcaatagnnnnnnn

SEQ ID NO: 404347 - DNA, 589 bp, Homo sapiens
  misc_feature: GZ8MTXP01APQTL.38.35.D02.1.454.CMB.2.raw
  modified_base (265)..(265): a, c, t, g, unknown or other
  modified_base (267)..(267): a, c, t, g, unknown or other
  modified_base (439)..(439): a, c, t, g, unknown or other
  modified_base (581)..(585): a, c, t, g, unknown or other
  modified_base (587)..(587): a, c, t, g, unknown or other
  modified_base (589)..(589): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctgggancngaggacacggctgtctattactgtgacgaaagacccgtcctcgtagtgggggtcgggtattagtgtcgtggggccacgggaccctggcccacgtctcctcaacgccctccgaccgaacgggcccacgtccggtcccttcccccgtcggccctcccctggcctccgagggacncccaccgtcgacgacgcacgacggccggcccggtggggccttcggccccgttaggacccaagggtacctacccttccgacgttgacgttccggaacttgggacgggtcggggttccaggggaccgaaggggccacgaatggnnnnngngn

SEQ ID NO: 404348 - DNA, 650 bp, Homo sapiens
  misc_feature: GZ8MTXP01A3LJ1.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgacgactctcctgtgcagcctcgtggatcaacttacaaaattagtgggatgctacgtgggtcccgccgaggctccgaggcgaagggggctgggacggtgggtggacaacgtatactcatatagataagggtaagttttaagacttagtcggacggtacgtcggagaacgggcccgtattccaaccactcctaccgaagacgaacaaattaccaaagtacgacaacctacgtaccttaatttagacctaaaatacgaacgtacggaccgtagggagtaccgtaggacgggaactacggttcttacggttactagttaacgttcggttacgttaccgggaaaaccggtaccccggaacccgttacgtacgggttcgggggttaaccggggttaaggtttaacgg

SEQ ID NO: 404349 - DNA, 689 bp, Homo sapiens
  misc_feature: GZ8MTXP01B2UM7.38.35.D02.1.454.CMB.2.raw
  modified_base (364)..(364): a, c, t, g, unknown or other
  modified_base (518)..(518): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagctcttttaagaggtgtccagtgtcagatgcagcgtggtggagtcgtgggggagtcggtggtccgaggccgtcggggggtccctggacgtactcctcctgtcgcagtcctgtggatacaaacttactaaaaagttgtagggatgactacgtcgggtccgccgaggcctcgaggcgaggggcgtgggaggtgggngactaagtatatctatagtagtagtaaggttaaagttttaagacttagtcgtacggacctacgggtaggaacgggtcctaatccaactactacctaccaaggacgaactaaactaccgaaagacacctaactactactttagttacaactaaanacgaacgacgtaccggtgggtacacggtacggaacgggtaacgaccgggttacttcggttaaccttacgttaacgttacggttacggttaaaccggtaaaacccggtaccccgggtaaccccgtttagggtacgggttacggggggtaaccgggttaacgggttttaaggg

SEQ ID NO: 404350 - DNA, 749 bp, Homo sapiens
  misc_feature: GZ8MTXP01DNDEF.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctggagactctcctgtcgcagcctctggatcaaacttacaaaaaattagtgggatggctacgtcgggtcccgccgaggctacccgagggacgaagggggcttagggaggtggggtgaccgaaactagtatactaagtagtagtaagttaagggtaaaagtttttaaacggaacttaaggtacgggaccgggtaaccgttacccggggttaggggaaaccgggggtccctaaactttaccgaaaccctaatacccgttacccgaaaggtaaacgtaacctaaaacgttaaccccgaaaagtaaccgacctaacccttaaccgttaccgtttaaatttacggaacctaaaagttaaccggaaacgtaacggacccgttaggggacgtaccgtaggaacggtaacgaacgggttcttcggttacttaagttacgttgggttacgaacggtaaaccggacccgtcccgttaggtcggttacggggtaacggggttaacgtttaagg

SEQ ID NO: 404351 - DNA, 617 bp, Homo sapiens
  misc_feature: GZ8MTXP01DC157.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggatcaaacttacaaaaattgtagggatgcacgtcgggtccgccaggcctaccgaggcgaagggggcttagggaggtgggtggacaacgtatactcatatgattaagggaaattttaacgactagtagcggtactccggtagaacgggcctattccacatcctaccgagacgaacaacttaccaagacgacaacctacgttcttaatttacgactaaagtgaacagccgtagggacgtctacgggaggaaccgacggttccgtagttaccttagttacttaggcgttaaccggaaaacgtaccccggtccgttaccgtagggttcggggtccgggttaagtttaacgg

SEQ ID NO: 404352 - DNA, 698 bp, Homo sapiens
  misc_feature: GZ8MTXP01C3VGY.38.35.D02.1.454.CMB.2.raw
  modified_base (555)..(555): a, c, t, g, unknown or other
  modified_base (574)..(574): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcttttaagaggtgtccagtgtcagatgcagctggtggagtcgtgggggagtcgtggtccaggtccgtggggggtccctggacgtactctccgtgtcgcacgcctcgtaggtactactaaacttaactaaaaaatttagagggtatcggaccgtacggttcggggtaccccgaccgacgggttcccgaaccgggagggaaccgggggtaacgggggtcgggttagggggtacgggggtttacgggacggtaaacctaaagttataccctaagtaagtagtaaggtaagttaaaaaggtttaaaagttaacgtaactagtacggacgtacgtacgggaggtacggacttactacactataccaagagaactaatactagaancatacctattacgtttaanacaataagacgaacgtacgtagacggagtacggtacgacgtaacgtcgttcttacgttacgttagtacgttacgacgaaacccggtaacgtcccgtgtaggtcgggttagggtcgttaagtcgg

SEQ ID NO: 404353 - DNA, 708 bp, Homo sapiens
  misc_feature: GZ8MTXP01BFPDN.38.35.D02.1.454.CMB.2.raw
  modified_base (315)..(315): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctgggtggagtcgtgggggagtcggtggtccaggccgtggggggtccctggacgactctcctgtgcagcctgtggatcaacttacaaaaattgtgggatgctagtcgggtccncaggcctcgaggcgaaggggctgggaggtgggtacgactaacgtatactctaattagtagtaagttaaagggttaaacgttttaagacgttagtacggaccggtacgtccggtagggaacgggtccgtattaccgaaccgtactaccgtaccgaagtaaacgaactaacttacccgaaagtcgaacctaaccttacttacgttaacgtttacgaactaaaacgtcgaaacgtacggtacccgtggggtaaccgtgtacgggaacggtaaccgtaccgggttcttacggttacttaaacgttacgttacggttaaccggaacccggtaaaaccggtaccccgggtcccttagggtaccgggttagggggtaacccggggttaagtttaaccggg

SEQ ID NO: 404354 - DNA, 583 bp, Homo sapiens
  misc_feature: GZ8MTXP01B63ZD.38.35.D02.1.454.CMB.2.raw
  modified_base (264)..(264): a, c, t, g, unknown or other
  modified_base (307)..(307): a, c, t, g, unknown or other
  modified_base (547)..(547): a, c, t, g, unknown or other
  modified_base (573)..(573): a, c, t, g, unknown or other
  modified_base (575)..(578): a, c, t, g, unknown or other
  modified_base (580)..(580): a, c, t, g, unknown or other
  modified_base (582)..(582): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctggganctgaggacacggctgtctattactgtgcgaaagaccggccctntagtggggtcgggatttatgtcgtggggccagggaccctggccacgtctcctcacgccctccaccaacgggcccatcggtcctccccgtggcccgccctgcctccagggtacgccacctccggagacgcccacgacggcccggcccgttacgggggccttaccggccccgttggggtacccgaaagggaccttaccgtttcccgacggttgaactccggaacttcgggacggtccggggngtcgggcaacgggttcgacgaatggngnnnngngng

SEQ ID NO: 404355 - DNA, 669 bp, Homo sapiens
  misc_feature: GZ8MTXP01CUF9Y.38.35.D02.1.454.CMB.2.raw
  modified_base (376)..(376): a, c, t, g, unknown or other
  modified_base (596)..(596): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagcgtgggtggagtcgtgggggacgtcgtggtccgaggccggtcggggggtccctggacgtacctctccgtgtcgcacgtcctcgtggtatacaaacttacaaaaagttgagggtaatcgctacgtcgggtcccgaccgaggccgtaccgaggacgaagggggctgggaggtggnggactaacgtatctactatagtagtaagtaaacgggttaaagttttaagacttaaggtcgtacggtacgtaccggagggaaacgggtccgtactaccgacctactactaccgaagtacgaactaacgtaccaagtacgacaacctacgttacttagtttacaaacctaagtaacgaacgacgtaccggtgggtacgcgtacggacggaacgtaccggttntcgttacgttagtcgttacgttacgaaccggtaacgccgtcgtacggtagggttcgggtaacggttggttaag

SEQ ID NO: 404356 - DNA, 641 bp, Homo sapiens
  misc_feature: GZ8MTXP01AYRQU.38.35.D02.1.454.CMB.2.raw
  modified_base (292)..(292): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggatcaaacttacaaaaattntgggatgctacgtgggtcccgccaggcctccgaggcgaagggggctgggaggtggggtcgactaaacgtatactacatatagtaagtaagggttaaattttaaggacttagtacgcggtaactccggtagaacgggccgtattccaacctatcctaccgaagacgaacaacgttaccaaagacacaactacgtacttattagaactaaagtacgaaaccgacggaccgtaggggtaagcgtacgggacggaaccgacggttccgttagttaccttagttacgttggttacgaacggaaaccgtacccggtcccgttagtagggttccggggtaacgggttaagttaagg

SEQ ID NO: 404357 - DNA, 688 bp, Homo sapiens
  misc_feature: GZ8MTXP01EYLY3.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggatcaacttacaaaaattatgggatgcacgtgggtcccgccaggctccgaggcgaagggggctggagtgggtgacaactatactcatatgaagtaagggtaaagttttaaagacttaagtggaccggtacttcccgggtaggaaacggggtcccgtaattaccaaccctaattccgttacccgaaaggaacgtaacctaaacttacccgaaagtaacgaccaaacctaaccgtttactttaaagtttacggaacctaaaaattcggaaaacctaggtaccccgtaggggaacgtccgtagggaacgggaaccgaacgggttctacggttcttaaagttaaccgttggttcggaaccggtaaaacggaaccccggtccccgttagtacgggttgggggtccgggggttaagtttaacgg

SEQ ID NO: 404358 - DNA, 606 bp, Homo sapiens
  misc_feature: GZ8MTXP01BFS4V.38.35.D02.1.454.CMB.2.raw
  modified_base (349)..(349): a, c, t, g, unknown or other
  modified_base (512)..(512): a, c, t, g, unknown or other
  modified_base (520)..(520): a, c, t, g, unknown or other
  modified_base (541)..(541): a, c, t, g, unknown or other
  modified_base (546)..(546): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggatcgtggtccagccgtggggggtccctgagactctcctgtgcagcctctggatacaaacttacaaaaattgtgggatgcacgtcgggtccgccgaggcctccgaggcgaagggggctgggaggttggggnggacaaacgtatactcatagtagagttaagggtaaagttttaacgactagtggacggtacttccgggaggaaacggggtccctaattccaacctaattcctacgaacgagtaaccaacgttacccgaaagataccaactaacgttcttaagttcaactaaacngaaaccgngcgtaggagcgaggcggaacncgttntattcgtactacgttgcgacgaacgaccgtccgtcgtaggttcggggtcgggttaaggtg

SEQ ID NO: 404359 - DNA, 637 bp, Homo sapiens
  misc_feature: GZ8MTXP01AQL6J.38.35.D02.1.454.CMB.2.raw
  modified_base (275)..(275): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagccgtggtggagtcgtgggggagtcggtggtccaggccggtgggggtccctgacgtactctcctgtgcagcctntggatacaaacttacaaaaattgtagggatcgcgacgtcgggtcccgccaggctaccgaggaccgaggggctgggagtgggtgacactatactcatagtagataaggtaaagtttaagactagtcgacggacgtcgagacggactatacacatctacaagagactactaccaagtacgacactacgtacgttattagactaaatagaaaccacggtacccggtagggacgtacgtacggacggaaccgacggttcgttcgttaccgttaagtttaccgttggttcggaaaccggtaaaccggtaaccccgggtcccttacgtacggggttacgggggttcgggggttaacgttttaacgggg

SEQ ID NO: 404360 - DNA, 680 bp, Homo sapiens
  misc_feature: GZ8MTXP01EW6JT.38.35.D02.1.454.CMB.2.raw
  modified_base (304)..(304): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagagactcaccatggagttggctgaacttgggttttcctcgtagtcttactttaagaggtgtccagtgtcagatgcagcgtgggtggagtcgtgggggatcgtggtccaggccggtggggggtccctggagtcctctccgtgtgcacgcctgtgtactacctaaacttactaaaaattgngggatcgactacgtcgggtcccgccaggcctacgaggacggaacgggggtctagggaggtgggtacgactaaactatactacaagtagtagaacgttaaaggttaaattttaagacgttagcggtacgaccgtcggtagggaacgggtaccgtattccaactatacctacgaagagaacctaactaccgaaagacactaacctacttacgttaattacaactaaagtacgaaacgtacgaccggttggaacgtccgaggaacggaaccctaagggttcttattaccgtaagtttaccgttaggttacggaaacccgaaaccggtaccccgtcccttacgggtacgggttggggtaaccgggttaaggtttaaccgg

SEQ ID NO: 404361 - DNA, 695 bp, Homo sapiens
  misc_feature: GZ8MTXP01CN7MH.38.35.D02.1.454.CMB.2.raw
  modified_base (321)..(321): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagcgtggtggagtcgtgggggagtcgtggtccaggccgtgggggtccctgacgactctcctgtgcacgtcctcgtggactacaacttacaaaaattgtaggatgctacgtcgggtcccncgacggcctaccgaggtaccggaagggggtcgtggggaggtggggacgactaacgttatactacgtattagtaggaagtttaaagggttaaagttttaagacttaaggtacggaccgggtacgttccgggtagggaaacgggaccgttagtacccacctacgtacctaccgaagaacgtaacaacgttaccgaaagacgtaccaaactacgttacttaatttacgaaactaaatcggtaaaccaggccggtagggacgaccgtagggaacggtaacgacggttcttggttacttaaacgttagttacgacgttaaccggaaaccgtacccggtaaccgttggtagggttcgggggtaacggttaaggttaacgg

SEQ ID NO: 404362 - DNA, 606 bp, Homo sapiens
  misc_feature: GZ8MTXP01ERG72.38.35.D02.1.454.CMB.2.raw
  modified_base (273)..(273): a, c, t, g, unknown or other
  modified_base (289)..(291): a, c, t, g, unknown or other
  modified_base (298)..(298): a, c, t, g, unknown or other
  modified_base (300)..(300): a, c, t, g, unknown or other
  modified_base (302)..(302): a, c, t, g, unknown or other
  modified_base (310)..(310): a, c, t, g, unknown or other
  modified_base (316)..(316): a, c, t, g, unknown or other
  modified_base (515)..(515): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagtactctcctgtcgcagctcgntcactactaatatgannnctgcgcngncngacacggngtgagngggtgcgactgtatccgatagtgagtagtaaagtttaaagtaacgtatacgtcgacgtaccgtgacggtacgggactacaccgaatctacccgtagaacgaacttactacaacgacgacaacctactacgttactttagacaaacgttacgacaacgcgtaggggacgtctaggacggtaacgcgtcggttcgtacttnttaccggttaagcggttcgaaacccggtaacgggtccccgtttaacgacgttacgggggttacgggggttaaccgttttaaggggtcccgg

SEQ ID NO: 404363 - DNA, 509 bp, Homo sapiens
  misc_feature: GZ8MTXP02ITUN3.38.35.D02.1.454.CMB.2.raw
  modified_base (495)..(495): a, c, t, g, unknown or other
  modified_base (503)..(509): a, c, t, g, unknown or other
tcagtcgatcacgtcacgaccggtgctcgatttagcacacgatagttgggtttgggagactctcctgtgcagcctctggattcaacttcaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgcgaaagaccggcctctatgggtcgggagttatgtctggggccaggggaccctggcccaccgtctcctcacgcctccaccaaggggccccatccggtcttccccctggccgccctgcctccaggacgcacctccgagacgcacagccggccctgggctgcctggtcaaggctactcacgtgatcgactgagcggctggccaaggcncgaatagnnnnnnn

SEQ ID NO: 404364 - DNA, 585 bp, Homo sapiens
  misc_feature: GZ8MTXP02JY6Y7.38.35.D02.1.454.CMB.2.raw
  modified_base (580)..(585): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgcgaaagaacccggccctctagtggggtcggggagttatgtcgtggggccaggggaaccctggcccaccgtctcctcacgcctccaccaacggggccccagtccggtccttccccctgggcccgccctgcctcccgaggacgccaccctccgagacgcaccgaggccgccccgtggggcctcggcccgtgggtaccaaaggggtacccttaacgttccccgaacggttcgaacttcccggaacgtcggacggccggggcctggggacccaaaggggccgacaagtaggcnnnnnn

SEQ ID NO: 404365 - DNA, 591 bp, Homo sapiens
  misc_feature: GZ8MTXP02H0BUN.38.35.D02.1.454.CMB.2.raw
  modified_base (414)..(414): a, c, t, g, unknown or other
  modified_base (439)..(439): a, c, t, g, unknown or other
  modified_base (584)..(584): a, c, t, g, unknown or other
  modified_base (586)..(591): a, c, t, g, unknown or other
tcagtcgatcacgtcacgaccggtgctcgatttagcacacgatagttgggtttgggagactctcctgtgcagcctctggattcaacttcaaaattatgggatgcactgggtccgccaggctccaggcaaggggctggagtgggtggcaactatatcatatgatggaagttttaagactatgcggactcgtgaaggccgattcaccatctccagagacaattccaagagcacactctatttgacaaatgaacagcctggagctgaggacacggctgtctattactgtgacgaaacgaaccggccctgtagtggggtcggggagttagtgtcgtggggccaaggggaaccctcgggcccaccgtctcctcacgccctccaaccgaacgggccccagttccggtccctttcccccgnggcccgcccctgccctccgaggacnccaccctccgagacgcacgacggccggtcctggggcctcggcccgtagggtacgaaacgggaccttaccgttaccgaaccgttgacgttaccggaccgttgggaacggccggggcgtcgggacccgaacgggcaccgaagttcgngnnnnnn

SEQ ID NO: 404366 - DNA, 522 bp, Homo sapiens
  misc_feature: GZ8MTXP02JFQ44.38.35.D02.1.454.CMB.2.raw
  modified_base (510)..(510): a, c, t, g, unknown or other
  modified_base (515)..(515): a, c, t, g, unknown or other
  modified_base (517)..(522): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgcgaaagaccggcctctatggggtcggggagttatgtcgtggggccaggggaaccctggccaccgtctcctcacgcctccaccgaacgggcccagtcggtccttcccccgtggcccgccctcgcctccaggacgccacctccgagacgcacagccggccctggggctcgcctaggtccaaggcctacgttcacgtgatcgactgagcggctggcaggcgntaagngnnnnnn

SEQ ID NO: 404367 - DNA, 594 bp, Homo sapiens
  misc_feature: GZ8MTXP02ISIB2.38.35.D02.1.454.CMB.2.raw
  modified_base (265)..(265): a, c, t, g, unknown or other
  modified_base (558)..(558): a, c, t, g, unknown or other
  modified_base (583)..(583): a, c, t, g, unknown or other
  modified_base (585)..(585): a, c, t, g, unknown or other
  modified_base (588)..(589): a, c, t, g, unknown or other
  modified_base (591)..(591): a, c, t, g, unknown or other
  modified_base (593)..(594): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaaacagcctgganctgaggacacggctgtctattactgtgacgaaacgacccggccctcgtagtggggtcggggagtttatgtcgtggggccaagggaacccctggacccaccgtctaccgtcacgccctccaccgaacgggccccacgtccggtcttccccccgtggcccgccctcgcctccgaggacgccacccgtccgacgacgaccacgacggcccgtccgtgggctcggccgtcggtacgaaacggtaccttaccgttacccacgttacggaactccgtaaccgtggaacggccggggtcncgggaccaaacgggcccgagtaagngngcnncncnn

SEQ ID NO: 404368 - DNA, 538 bp, Homo sapiens
  misc_feature: GZ8MTXP02GSQFR.38.35.D02.1.454.CMB.2.raw
  modified_base (289)..(289): a, c, t, g, unknown or other
  modified_base (348)..(348): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaacttcaaaaattntgggatgcactgggtccgccaggctccgaggcaaggggctgggagtggggtggcaactntactcatatgatggaatttagactatgcggactcgtagaagggccgtatcaccatctccagacacaattccaagagacacactcttattgacaaatgaaacagcctagggagcgtgaggacacgggctacggtactagttactggtgacgtaaacgacccggcctacgtagtcggggtcgggtagtttag

SEQ ID NO: 404369 - DNA, 557 bp, Homo sapiens
  misc_feature: GZ8MTXP02JWH2K.38.35.D02.1.454.CMB.2.raw
  modified_base (264)..(264): a, c, t, g, unknown or other
  modified_base (550)..(550): a, c, t, g, unknown or other
  modified_base (552)..(557): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctggganctgaggacacggctgtctattactgtgcgaaagaccggccctcgtagtggggtcgggattagtgtcgtggggccaggggaaccctggccaccgtctcctcacgcctccaccgaacggggccccagtccggtcttccccccgtgggcccgccccgtgccctccgaggacgccaccctccgaagacgccacgaggccggcccgtggggctcggcctggtaccaacgggtctaccttccgacgttgaactcggactggacgcgggctacgggcaacggcgacaagcggngnnnnnn

SEQ ID NO: 404370 - DNA, 528 bp, Homo sapiens
  misc_feature: GZ8MTXP02JVZAX.38.35.D02.1.454.CMB.2.raw
  modified_base (264)..(264): a, c, t, g, unknown or other
  modified_base (399)..(399): a, c, t, g, unknown or other
  modified_base (404)..(404): a, c, t, g, unknown or other
  modified_base (500)..(500): a, c, t, g, unknown or other
  modified_base (512)..(512): a, c, t, g, unknown or other
  modified_base (522)..(528): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaaggccgattcaccatctccagagacaattccaagagcacactctatttgcaaatgaacagccctggganctggaggacacggctgtctattactgtgacgaaagaacccggcctctagtggggtcgggagttatgtcgtggggccagggacctggccaccgtctcctcacgcctccaccaagggcccagtcggtccttcccccnggccnccctgcctcccgaggacgcaccctccgacgacgcacgagccggcccgtgggcctgccgttggccaaggactacttccacgtgatcgactgagcggntcggcgaacggngacaagtagnnnnnnn

SEQ ID NO: 404371 - DNA, 583 bp, Homo sapiens
  misc_feature: GZ8MTXP02JVFT2.38.35.D02.1.454.CMB.2.raw
  modified_base (290)..(290): a, c, t, g, unknown or other
  modified_base (363)..(363): a, c, t, g, unknown or other
  modified_base (415)..(415): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaaacttcaaaaattntagggatgcacgtgggtccgccaggctccgaggccgaaggggctgggaggtgggtggcaaacgtatatcatanagataggaaagttttaagactatgacgactcgtaggacgggccattcactanctccagacaacaacttaccaagacgacactactcttatttagactaaaatgaaacagaccgtagggagtctagggaagaccgacgggctcggtacttagttaccttggacgaaccgaaaacggacccggtaccctacggtaggtccgggggtacggggtagtttacgg

SEQ ID NO: 404372 - DNA, 553 bp, Homo sapiens
  misc_feature: GZ8MTXP02GI537.38.35.D02.1.454.CMB.2.raw
  modified_base (308)..(308): a, c, t, g, unknown or other
  modified_base (546)..(546): a, c, t, g, unknown or other
  modified_base (548)..(553): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgcgaaagaaccggccctntagtggggtcggggagttagtgtcgtggggccaggggaaccctggccaccgtctcctcacgccctccaccaaggggccccatccggtcttcccccgtggcccgccctgcctccgaggacgccaccctccgagacgccacacggccggccctggggcctcggccctgggtccaaggaccttacgttcccagtcgatccgactggacgcggggctgggacgaacgggtcgacaagtaggngnnnnnn

SEQ ID NO: 404373 - DNA, 563 bp, Homo sapiens
  misc_feature: GZ8MTXP02IT2CS.38.35.D02.1.454.CMB.2.raw
  modified_base (297)..(297): a, c, t, g, unknown or other
  modified_base (379)..(379): a, c, t, g, unknown or other
  modified_base (420)..(420): a, c, t, g, unknown or other
  modified_base (424)..(424): a, c, t, g, unknown or other
  modified_base (436)..(436): a, c, t, g, unknown or other
  modified_base (559)..(560): a, c, t, g, unknown or other
  modified_base (562)..(563): a, c, t, g, unknown or other
tcagtcgatcacgtcacgaccggtgctcgatttagcacacgatagttgggtttgggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctgggagctgaggacacggctgtctattacnggtgacgaaaagacccggccctcgtagtggggtcggggattagtgtcgtggggccacggggaccctggccaccgtctcctcncgccctccaccgacggcccagtccggtcctcccccgtgccncccngcctccgaggcnccacccgtccgagacgccacgacgccggcccgtgggcctcgcccgttggacaaacggtaccttaaccttccgacgtcgacgtccgactggacggtcgggctcgggcgaaagggcgcaagtcgnncnn

SEQ ID NO: 404374 - DNA, 794 bp, Homo sapiens
  misc_feature: GZ8MTXP02I4Z2H.38.35.D02.1.454.CMB.2.raw
  modified_base (267)..(267): a, c, t, g, unknown or other
  modified_base (787)..(787): a, c, t, g, unknown or other
  modified_base (790)..(790): a, c, t, g, unknown or other
  modified_base (792)..(792): a, c, t, g, unknown or other
  modified_base (794)..(794): a, c, t, g, unknown or other
tcagtcgatcacgtcacgaccggtgctcgatttagcacacgatagttgggtttgggagactctcctgtgcagcctctggattcaacttacaaaaattatgggatgcactgggtccgccaggcctccaggcaaggggctggagtgggtggcaactatatcatatgatggtaagttttaaagactatgcggactccgtgaaggccgattcacatctccagagacaattccaagagcacactctatttgactaaatgaacagccgtgganctgagacacggctgtctattactggtagacggtaaaacgaacccggcccttacgtaggtgggggttaccggggtaatttagtcggttcggtcggggtacccggacggggtaaaccccgtccggaccccgtacccggttcccttcccctaccgaccggacccccttacccccggaaacccgtaaacccgggggtccccctaaaccggtttccccggggttaccccccgttttcccccccggttcgggcccccgtccccccgtttacgcccccggttaccccgaacgggggttaaacccccgacccccgtaaccccggtacccggaacggacccggaacccgacccggtacccggggtccccgggtccccgggttcggggtcccgttacccggtaccgggttaaccgggtaacccggtaaaaccgggttacccttacccgttaccggtacggtacgtacgtaccgtacggtacgggacgggaccgggtacgacgggacggaacggcgtacgaacgtcgcgcngcncncn

SEQ ID NO: 404375 - DNA, 548 bp, Homo sapiens
  misc_feature: GZ8MTXP02ITDUF.38.35.D02.1.454.CMB.2.raw
  modified_base (289)..(289): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaacttcaaaaattntgggatgcactgggtccgccaggctccgaggcaaggggctgggagtggggtggacaactatactcatatgataggaaattttaagctatgcgactcgtagaagggccattcaccatctcagacacaatccaagacgacacactacttattgacaaatgaactagccgtagggacgcgtagaacggacacggctcgtactaattacgtgtcgacgaaaacgaacccggccctagtaacgtcggggtacgggtatttacgg

SEQ ID NO: 404376 - DNA, 516 bp, Homo sapiens
  misc_feature: GZ8MTXP02HE796.38.35.D02.1.454.CMB.2.raw
  modified_base (264)..(264): a, c, t, g, unknown or other
  modified_base (308)..(308): a, c, t, g, unknown or other
  modified_base (512)..(516): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctggganctgaggacacggctgtctattactgtgacgaaagaccggccctntagtggggtcggggagttatgtcgtggggccaggggaccctggccaccgtctcctcacgcctccaccgaagggccccagtccggtcctcccccgtggccgccctgcctccgaggacgccacctccgagacgcacagccgccgtgggctgcctgcaggctactcacgtgactcgactgagcggctcggcgaaggcgcaagtagcnnnnn

SEQ ID NO: 404377 - DNA, 642 bp, Homo sapiens
  misc_feature: GZ8MTXP02JP0R8.38.35.D02.1.454.CMB.2.raw
  modified_base (270)..(270): a, c, t, g, unknown or other
  modified_base (464)..(464): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctggtggagtcgtgggggagtcgtggtccagccgtgggggtccctgagactctcctgtgcagcctntggattcaaacttacaaaaaattgtagggatgcacgtcgggtccgccaggcctccgaggcgaaggggctgggaggtgggtggacaaacgtatatcatatgagttaggtaaaagtttttaagacttaatggacgtactccggtaggaacgggccgtattccaactatcctaccaagagaacaacttaccaaaganaccactaacttacttatttacgaactaaagacgaaacacggcccgtaggggaccagtacggaacgggaccgaaaccgggtcctagttaccttaagtttaaccttggtacgaaccggtaaaaccgaccccgggtacccctacggtaaggttccgggggtacggggtttaacgtttcggg

SEQ ID NO: 404378 - DNA, 566 bp, Homo sapiens
  misc_feature: GZ8MTXP02JNMN5.38.35.D02.1.454.CMB.2.raw
  modified_base (290)..(290): a, c, t, g, unknown or other
  modified_base (522)..(522): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaaacttcaaaaattntagggatgcacgtgggtccgccgaggctccgaggcgaaaggggctgggagtggggtgacaacgtatactcatatgataggtaaagttttaagacttaatgacggactccgtagaacgggcctattccaccatcctccaagacgaacaacttaccaaagacgaccaacactctatttgactaaatcgaaacacgaccgtgggagcgtagacggacgacggctgtactattacngtacgacgaaaagacccgcctagtagtcggggtcgggtagttag

SEQ ID NO: 404379 - DNA, 618 bp, Homo sapiens
  misc_feature: GZ8MTXP02HBE51.38.35.D02.1.454.CMB.2.raw
  modified_base (291)..(291): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggatcgtggtccagccgtggggggtccctggagactctcctgtgcagcctctggattcaacttacaaaaattntagggatgacagtcgggtccgcaggcctccgaggcgaaggggctgggagtgggtggacaaacgtatactcatatgataggtaaattttaagacttagtggacggtactccggtaggaacgggccgattccaacactctacccgagtacgaactaactaccaaagcacactactcttaattagactaaaatcgaaactcgaccgtagggacgtacgtaggacggaccaacgggtccttaggtacttaacgttaccgttaggacgaaccggaaaacggtaaccccggtccgttacgtaacggttcgggggtaccggggtaagtttacgg

SEQ ID NO: 404380 - DNA, 567 bp, Homo sapiens
  misc_feature: GZ8MTXP02FOHW7.38.35.D02.1.454.CMB.2.raw
  modified_base (266)..(266): a, c, t, g, unknown or other
  modified_base (561)..(567): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaaacagcctggganctgaggacacggctgtctattactgtgacgaaagacccggcctctagtggggtcgggattatgtctggggccaggggaccctggcccaccgtctcctcacgcctccaccgaagggcccagtccggtccttcccccgtggcccgccctgcctccgaggacgccacccgtccgagacgcacgacggccggaccctggggcctcggcccgttggtaccaaagggtccttacgttcccgacggttagaactccggaactggaacggcggggtctcgggccgaaacgggcacgaagtagnnnnnnn

SEQ ID NO: 404381 - DNA, 653 bp, Homo sapiens
  misc_feature: GZ8MTXP02HC8OT.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtcgcagcctctggattcaacttacaaaaattagtaggatgcacgtcgggtccgccgaggcctccgaggtcgaaggggctgggaggtgggtggacaactagtactacatagtgaagttagggtaaaagtttttaagacttagtacgaccggtaccgtcgtaggaacgggacccgtagttacccacctacgttcctaccgtagaacgaactaacttaccaaaggacacaactactacttattgaccaaaatcgaacacgtcccgtagggacacgtaggaacggtaaccgacggtcttacggtactttacgttaccgtaggtacgaaaccgggtaaaaccggtaaccccggtaccccttaggtacgggttcgggggtacggggttaacgtttcggg

SEQ ID NO: 404382 - DNA, 645 bp, Homo sapiens
  misc_feature: GZ8MTXP02G7PVB.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgacgactctcctgtgcagcctctggattcaacttacaaaaattagtagggatgacacgtcgggtccgccgaggcctccgaggacgaaggggcgtagggaggtggggtagacgtaaactatacgtcattatagtagttaggttaaagttttaagacttaagtacggtccgtacgttaccggtaggaaacggggcccgtaagttccaacctacgtcctacccgagaacgaactaacttacccgaaagacgaccaacctactacttattacgacaaatagaacgtacgccgtagggagaccgtaggaacggacgacgggtcctaggtactaagttacgtagtacgaacggaaacgtaacccggtcccgttacgtacggtacggggtacgggtagtttacgg

SEQ ID NO: 404383 - DNA, 597 bp, Homo sapiens
  misc_feature: GZ8MTXP02GO3BQ.38.35.D02.1.454.CMB.2.raw
  modified_base (272)..(272): a, c, t, g, unknown or other
  modified_base (381)..(381): a, c, t, g, unknown or other
  modified_base (587)..(587): a, c, t, g, unknown or other
  modified_base (592)..(592): a, c, t, g, unknown or other
  modified_base (594)..(594): a, c, t, g, unknown or other
  modified_base (596)..(597): a, c, t, g, unknown or other
tcagtcgatcacgtcacgaccggtgctcgatttagcacacgatagttgggtttgggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctggganctggaggacacggctgtctattactgtgacgaaagacccggccctcgtagtggggtcgggagttagtgtcgtggggaccaggggaacccctggaccaccgtctccctcncgccctaccaccgaacggcccagtccggtccttcccccgtggcccgccctgcctcccgaggacgcccaccgtccgacgacgccgacgacggtcccggcccgtgggccgtcgcccgtcgggtaccaaacgggtaccttaccgttacccgacgttacggacttaccggactgggaacggtcggggactacgggcaaaggggccacganacggncncnn

SEQ ID NO: 404384 - DNA, 537 bp, Homo sapiens
  misc_feature: GZ8MTXP02GCYW6.38.35.D02.1.454.CMB.2.raw
  modified_base (306)..(306): a, c, t, g, unknown or other
  modified_base (466)..(466): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattatgggatgcactgggtccnccaggctccaggcaaggggctggagtgggtggcaaactatatcatatgataggtaagttttaagctaatgcgactcgtaggaacgggccgattcaccaatctccagacgacaaattccaaagagacacactctaatttgacaaatgaaacagcctgggancgtgaggacacggactgtctattacgtgtgacgaaagaacccgcctactagtcggggtacgggtatttagg

SEQ ID NO: 404385 - DNA, 643 bp, Homo sapiens
  misc_feature: GZ8MTXP02H2GRR.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtgggggtccctgagctctcctgtgcagcctctggattcaaacttacaaaaattgtgggatgcacgtgggtccgcgaggcctaccgaggccgaaggggctgggaggtggggtacgacaaactatactacatatgtaattagggttaaagtttttaagacttaagtacggaccggtaacgttcccggtagggaaacgggggtccctaaacgttcccgaaccctaactcccgttacccgaagaacgaactaaacgtacccaaagacgaccaacctacttacttagtttacgactaaaactcgaaacagtccgtagggaacgccgtaggaacggaccacgggtctagtcttaaacttcgagtacgaacgaaaccggtaccgaccctacgtaggtcggggtacggtagttcgg

SEQ ID NO: 404386 - DNA, 646 bp, Homo sapiens
  misc_feature: GZ8MTXP02HFEIR.38.35.D02.1.454.CMB.2.raw
  modified_base (290)..(290): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaacttacaaaaattntagggatgcacgtgggtccgccaggctccgaggcgaaggggctgggagtgggtggacaaacgtatactcatatgtaagtaggtaaagttttaagacttaagtgacggtacttccggtaggaaacggggtccgtaattacccgaacctagtacctacccgagaacgaaccaaacttacccgaaagacgaccaaacctaaccttacttaattttacgacctaaaaattcgaaacaacggccgttagggacgtcgtagggacggaacgacggtctacggttacttaattacgtagttacgaaccggaaaacgacccggtacccgttacgtaacggtcgggggtacggggtagtttacgg

SEQ ID NO: 404387 - DNA, 572 bp, Homo sapiens
  misc_feature: GZ8MTXP02JB7CQ.38.35.D02.1.454.CMB.2.raw
  modified_base (265)..(265): a, c, t, g, unknown or other
  modified_base (416)..(416): a, c, t, g, unknown or other
  modified_base (439)..(439): a, c, t, g, unknown or other
  modified_base (540)..(540): a, c, t, g, unknown or other
  modified_base (565)..(565): a, c, t, g, unknown or other
  modified_base (568)..(572): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctggganctgaggacacggctgtctattactgtgacgaaagacccggcctgtagtggggtcggggagttagtgtcgtggggccaggggaacccctgggccctaccgtctccctcacgccctccgaccgaacggggcccagtccggtcccttcccccgngggcccgccctgcctccgaggcncccaccgtcgagacgccaacgcggtccggcccgtggggcctacggccgtggtaccgaaacggccttacgtccacggtgacgtccgactggacggccgggtntacgggcaacggggcacgaagtggngcnnnnn

SEQ ID NO: 404388 - DNA, 568 bp, Homo sapiens
  misc_feature: GZ8MTXP02F6IE0.38.35.D02.1.454.CMB.2.raw
  modified_base (292)..(292): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggattcaacttacaaaaattntgggatgcacgtgggtccgcaggctccgaggccgaaggggctgggagtggggtgcaactatactcatatgataggtaaagttttaagacttatggaccgtactccgtagaacgggccgattcaccatctccagacgacaaattccaaagacgacaacacttactatttgaactaaaatacgaaacacgaccgtagggaactcgtagacggacacggctcgtactattacgtgtagacgaaacgacccgcctagtacgtcggggtacggtagtttag

SEQ ID NO: 404389 - DNA, 552 bp, Homo sapiens
  misc_feature: GZ8MTXP02IS036.38.35.D02.1.454.CMB.2.raw
  modified_base (268)..(268): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtgggggtccctgagactctcctgtgcagcctcnggattcaacttcaaaaattatgggatgcactgggtccgccaggctccaggcgaaggggctggagtgggtgcaactatatcatatgataggtaagtttaagactagtagcgactcgtgaagggccattcacatctccagagacaatccaagagacacactactattgactaaatcgaacagccgtagggatacgaggacggacgacgggtcctaggtaccttaattacgtgtacgacgaaaacgtacccggtacctacgtagtcgggggtacgggtagtttacgg

SEQ ID NO: 404390 - DNA, 593 bp, Homo sapiens
  misc_feature: GZ8MTXP02FUSXY.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggattcaaacttacaaaaaattataggggaatgacacgtcgggtcccgccgaggcctcccgaggcgaaaggggctgggaggtgggtggacaaactatactcatatgataggtaaagttttaagctatggacgactccgtagaacgggcattcaccatctcccagacgaacaacttaccaaagacgacaacactacttattgaacaaatagaaacgacgaccgtaggggagacgtagaacggaacgacggacttcgtacttagttactagtacgaacgaaacgacccgtaccgtacgtaggtcggggtacgggtagtttaagg

SEQ ID NO: 404391 - DNA, 630 bp, Homo sapiens
  misc_feature: GZ8MTXP02H3AEV.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtgggtccaggccgtggggggtccctggagactctcctgtgcagcctctggattacaaacttacaaaaaattgtaggggatgccacgtcggggtcccgccaggcctccgaggccgaaggggctggggagtggggtgactaaactatactcatatagtataggtaaagttttagacttagtgcggtactccggtgaacgggccgagttcaccgactcctaccaagacgactaattacccaagacgacaactacctacgttaatttcgaactaaatacgaacacggccgtagggacgcgtagaacggtacgacgggtctacgtaccttaagttaccgttagtacggaaccggaaaacggtaccccggtacccgttacgtaggtccgggggttacgggtaggtttacgg

SEQ ID NO: 404392 - DNA, 598 bp, Homo sapiens
  misc_feature: GZ8MTXP02F81OI.38.35.D02.1.454.CMB.2.raw
  modified_base (310)..(310): a, c, t, g, unknown or other
  modified_base (535)..(535): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtgcagcctctggattcaacttacaaaaattatgggatgcacgtgggtccnccaggcctccgaggcaaggggctggaggtgggtgcaactatactcatatgataggtaagttttaagactatgacgactcggtgaacgggccattccacctatcctacccaagacgaactaagttacccaaagacgaccaacaacttcttatttacgacctaaaatcgaaacagtccgtaggggacgtactggaacggacacgggtcttaggtccttaagttaccnggttacgaaccgaaaacggaccccggtacctacgtacggtcggggtaccggggtatttacggg

SEQ ID NO: 404393 - DNA, 570 bp, Homo sapiens
  misc_feature: GZ8MTXP02G1RHO.38.35.D02.1.454.CMB.2.raw
  modified_base (274)..(274): a, c, t, g, unknown or other
  modified_base (341)..(341): a, c, t, g, unknown or other
  modified_base (429)..(429): a, c, t, g, unknown or other
  modified_base (453)..(453): a, c, t, g, unknown or other
  modified_base (517)..(517): a, c, t, g, unknown or other
  modified_base (560)..(560): a, c, t, g, unknown or other
  modified_base (564)..(564): a, c, t, g, unknown or other
  modified_base (566)..(570): a, c, t, g, unknown or other
tcagtcgatcacgtcacgaccggtgctcgatttagcacacgatagttgggtttgggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaaacagcctggganctgaggacacggctgtctattactgtgacgaaagaacccggcctcgtagtggggtcggggatttagngttcgtggggccacggggaaccctgggacccaccggtctccgtcacgccctaccaccgaacgggccccagtccggtcccttcccccgnggcccgcctcgccaccgacggccnccacccgcgacgacgaccacgcggccggccgtgggcctcgccgtggacaacgtctacgtaccgngtcgacgtcgacgtcggacggcggctacggacgaacggcgtanacgngnnnnn

SEQ ID NO: 404394 - DNA, 634 bp, Homo sapiens
  misc_feature: GZ8MTXP02IFRVS.38.35.D02.1.454.CMB.2.raw
  modified_base (295)..(295): a, c, t, g, unknown or other
  modified_base (313)..(313): a, c, t, g, unknown or other
  modified_base (523)..(523): a, c, t, g, unknown or other
tcagtcgatcacgtcacgaccggtgctcgatttagcacacgatagttgggtttggggagctctgggagaggagtccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccgtgggggtccctggagactctcctgtgcagccctcgtggattcaacttacaaaaattgngggatgcacgtgggtccnccaggcctccgaggccgaaggggctgggaggtggggtcggacaaactatacgtcatatgagtaggtaaaagtttttaagcttaagtggaccggtactccggtagaaacgggcccgtattccaccatcctacccgagaacgaactaaacttacccgaaagacgaccaacacttacttaattcgacaaaatcgaaacagacccgtgggaacnccgtaggaacggaccgacgggcctagtaccttaattaccgtggttacgaacgaaaacggaaccccgacccgttacgtaaggttcgggggtaccggggttaacgtttacggg

SEQ ID NO: 404395 - DNA, 696 bp, Homo sapiens
  misc_feature: GZ8MTXP02F423J.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcttttaagaggtgtccagtgtcagatgcagcgtggtggagtcggtgggggagtcggtggtccgaggccggtcgggggtccctgacgtcctctcctgtgcacgcctgtggtacttacaaacttaacaaaaattgtagggatcgaccacgtcgggcccgccgaggcctaccggaggacggaaggggcgtaggggagggttggggacgactaaacgttatacgtactatagtaggtaagttaaggttaaaagttttaagacttaagtcggaccgtacgtacggaggaacgggtacctacgttacccacctactacctacgaagacgtaactaactaccgaaagacactaacctacttacttattacgaactaaagtacgaacgacgtccggtaagggacgtacgtaggaacggaccgtacggtcttacgttaacttacgttacgtacggtaccggaaaaccggaaacccggtaccccggtacccgttacggtagggttacgggggtacggggttagtttacggg

SEQ ID NO: 404396 - DNA, 588 bp, Homo sapiens
  misc_feature: GZ8MTXP02HON9B.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtgggggtccctgagactctcctgtgcagcctctggattcaacttacaaaaattatgggatgcacgtgggtccgccaggcctccgaggcgaaggggctgggagtggggtgcaacgtatactcatatagattaggtaaagttttaagactatgacgtactccgtagaaacgggcattcacatctccagacactaatccaaagagacacacttcttaattcgacaaaatgaaactacgcgtagggaagcgtagacggaacacggctacgttcttaattaccgtaggttagaccggaaaacggtacccggacccttacgaaacggtttcgggggtaccgggggtttaagtttacggg

SEQ ID NO: 404397 - DNA, 562 bp, Homo sapiens
  misc_feature: GZ8MTXP02H21PS.38.35.D02.1.454.CMB.2.raw
  modified_base (271)..(271): a, c, t, g, unknown or other
  modified_base (316)..(316): a, c, t, g, unknown or other
  modified_base (533)..(533): a, c, t, g, unknown or other
  modified_base (557)..(557): a, c, t, g, unknown or other
  modified_base (559)..(562): a, c, t, g, unknown or other
tcagtcgatcacgtcacgaccggtgctcgatttagcacacgatagttgggtttgggggtccctgagactctcctgtgcagcctctggattcaacttcaaaaattatgggatgcactgggtccgccaggctccaggcaaggggctggagtgggtggcaactatatcatatgatggaagttttaaagactatgcggactcgtgaaggccgattcaccatctccagagacaattccaagagcaacactctattgacaaatgaacagcctggganctgagacacggctgtctatactgtgacgaaaacgaccggcccctntaagtggggtacggggagttagtgtcgtggggcctaaggggaacccctgggccccacggttctcctcacgccctccaacccgaaacgggccccagtccgtccctccccctggcccgccctggcctcccgaggacgccaacccgtccgagacgcacagcggccctgggcctgccgtggacaaggactacctcgacgtgactcgactcgacgcgggtcncggacaacgggcgtacgaacgagngnnnn

SEQ ID NO: 404398 - DNA, 588 bp, Homo sapiens
  misc_feature: GZ8MTXP02G1WOH.38.35.D02.1.454.CMB.2.raw
  modified_base (366)..(366): a, c, t, g, unknown or other
  modified_base (461)..(461): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggattcaaacttacaaaaaattagtagggatgcacgtgggtccgccaggctcccgaaggccgaaaaggggctagggaggtggggtggcaaactanaatcatatgaagtaggaaaagtttttaacgattaaatggaccgtactccgtagaaacgggccgattcaaccatcaccagacaacaaatcaaaganacaacactcttaatttgacaaaatacgaacaacgaccgacggagacgagagacgaacgcgtagtctacttactacgtagacgaaacgaaaccgacccgtacctagtaggtacggggtacggttaagg

SEQ ID NO: 404399 - DNA, 559 bp, Homo sapiens
  misc_feature: GZ8MTXP02GGG6L.38.35.D02.1.454.CMB.2.raw
  modified_base (481)..(481): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtgggggtccctgagactctcctgtgcagcctctggattcaacttacaaaaattatgggatgcacgtgggtccgccaggctccgaggcgaaggggctgggaggtggggtggacaacgtatactcatatgaatggtaagtttaagactatgcgactcggtagaacgggccgagttcaccatctccagagaacaattaccaaagacgacacactctatttagactaaatacgaaacagacctagggacncgtagaggacgacggctcgtactacttacgtgtacgacgaaaacgacccggctacgtagtcgggtacgggagtttacg

SEQ ID NO: 404400 - DNA, 540 bp, Homo sapiens
  misc_feature: GZ8MTXP02FXHQZ.38.35.D02.1.454.CMB.2.raw
  modified_base (226)..(226): a, c, t, g, unknown or other
  modified_base (257)..(257): a, c, t, g, unknown or other
  modified_base (283)..(283): a, c, t, g, unknown or other
  modified_base (318)..(318): a, c, t, g, unknown or other
  modified_base (357)..(357): a, c, t, g, unknown or other
  modified_base (402)..(402): a, c, t, g, unknown or other
  modified_base (406)..(406): a, c, t, g, unknown or other
  modified_base (533)..(533): a, c, t, g, unknown or other
  modified_base (535)..(535): a, c, t, g, unknown or other
  modified_base (538)..(538): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaattttaagctatgcggactccgtgaaggccattcaccatctccagagacaattccaagncacactctattgcaaatgaacagcctggganctgaggacacggctgtctatactgtnacgaaagaccggtcctatagtgggtcgggattagnggtcgtggggcctacggggaccctcgggacctaccggtntaccgtcgacgtcctccgactaacgggcctagtccgtctccccgngccncctgctcgagcgcacctcgagtacgcacgacgccgtccgtggctcggtccgtggacaacggtcctacgttccgagtacgactcgacgtcgacggcggctaggcgaacggcctacgaagtacgctcgncncancg

SEQ ID NO: 404401 - DNA, 593 bp, Homo sapiens
  misc_feature: GZ8MTXP02JZBRL.38.35.D02.1.454.CMB.2.raw
  modified_base (271)..(271): a, c, t, g, unknown or other
  modified_base (295)..(295): a, c, t, g, unknown or other
  modified_base (315)..(315): a, c, t, g, unknown or other
  modified_base (371)..(371): a, c, t, g, unknown or other
  modified_base (455)..(455): a, c, t, g, unknown or other
  modified_base (587)..(587): a, c, t, g, unknown or other
  modified_base (590)..(590): a, c, t, g, unknown or other
  modified_base (592)..(593): a, c, t, g, unknown or other
tcagtcgatcacgtcacgaccggtgctcgatttagcacacgatagttgggtttgggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaaggccgattcaccatctccagagacaattccaagagcacactctatttgcaaatgaacagcctggganctgaggacacggctgtctattacngtgcgaaagacccggccctntagtgggtcggggattagtgtctggggccagggaaccctggcccaccggtctcctncgcctccaccgagggcccagtccggtcctcccccgtggcccgccctcgcctcccaggacgccacccgtccgacgacgcaaccgnggtcccggccccgtggggcctcggccccgtagggtccaaagggtaccctacgtttacccgacggttcgaacgttcccgacgttcggaaacgggccgggaccgtgggacccgaaaggggcgacgaagtacggngcncnn

SEQ ID NO: 404402 - DNA, 605 bp, Homo sapiens
  misc_feature: GZ8MTXP02IJ5F7.38.35.D02.1.454.CMB.2.raw
  modified_base (290)..(290): a, c, t, g, unknown or other
  modified_base (413)..(413): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagcctgggggtccctgagactctcctgtgcagcctctggattcaacttcaaaaattagngggatgcacgtgggtccgcaggcctcccgaggcgaaggggctgggagtgggtgcaacgtatatcatatgatggtaaagtttagactatggcgactcgtggaaggtccgatccgacatctccanacgaactaattaccaaagacgacaccaacttctatttcgactaaaatcggaactaaggcccgtagggaacgtccgtaggaaacgggtacgaacggtcgtacggttacttaatttaccgtaggttaccgacggtaaaacgtaaaccccgggtcccttaccgtaaggtccggggttaacgggggtactttacgg

SEQ ID NO: 404403 - DNA, 708 bp, Homo sapiens
  misc_feature: GZ8MTXP02JL6JO.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctggagctctcctgtgcagcctctggattacaaacttacaaaaattatgggatgcacgtggtccgccgaggcctccgaggcgaaggggctgggaggtggggtggactaaactatactcaatataggtagttaaggttaaaagtttttaacggactttaagtcggtaccgggtaccgttaccgggtagggaaacgggggtacccgtaactttaccgaaccctaattcccgtacccgaaagtacgaaacctaaacgttacccgaaaagtacgaccaacctacttaccttaagtttagaaacctaaaattacgaaactacggacccgtaggggaacgtcgtaggaacggaccgtaccggtctacggttaccttaagtttacgtacggttaacgaaccggtaaaaccggtaccccggtacccgttacgtagggtttacgggggtaccgggggttaatttacgggg

SEQ ID NO: 404404 - DNA, 624 bp, Homo sapiens
  misc_feature: GZ8MTXP02JIOCH.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagactctcctgtgcagcctctggattcaacttacaaaaattgtagggatgcacgtcgggtcccgccaggctccgaggcgaaggggctgggagtgggtgacaactatactcatatgagtaggtaaattttaagacttagtgacggtacgtaccgtaggaacgggtccgtattaccaacctacgtcctacccgagtaacgaactaacgttaccaaagacgtacaactactacttatttacgacaaaatcgaaacgacgtccgtaggagtccgtagacggaacgcggtactacgtacttaacgttccgtaggtacgaacggaaaaccggtaccccggtaccctacggtacggtacggggtaccggggtagtttacgg

SEQ ID NO: 404405 - DNA, 643 bp, Homo sapiens
  misc_feature: GZ8MTXP02GEJLH.38.35.D02.1.454.CMB.2.raw
  modified_base (265)..(265): a, c, t, g, unknown or other
  modified_base (642)..(642): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctggganctgaggacacggctgtctatactgtgacgaaagacccgcctcgtagtggggtcggggattagtcggtcgtggggaccacggggaccctggcccaccgtctcctcgacgcctccgaaccgaacggggccctacgtccggttcccttcccccgtgggccctccctgccctaccgaggacgcccaccgtaccggagacgaccaccgtacggccccgggtccctgggggccttcggcccggtttacgggacccaaacggggtacccttaccgtttacccgacggttacgacgttccggaacgttcgggaacgggcccggggtacgttcgggggaacccgtaaacgggggcctaaccgtaaaaggtacgcgcgcgcgcgcgng

SEQ ID NO: 404406 - DNA, 604 bp, Homo sapiens
  misc_feature: GZ8MTXP02HOZ74.38.35.D02.1.454.CMB.2.raw
  modified_base (260)..(260): a, c, t, g, unknown or other
  modified_base (268)..(268): a, c, t, g, unknown or other
  modified_base (290)..(290): a, c, t, g, unknown or other
  modified_base (330)..(330): a, c, t, g, unknown or other
  modified_base (336)..(336): a, c, t, g, unknown or other
  modified_base (468)..(468): a, c, t, g, unknown or other
  modified_base (589)..(589): a, c, t, g, unknown or other
  modified_base (599)..(599): a, c, t, g, unknown or other
  modified_base (601)..(601): a, c, t, g, unknown or other
  modified_base (603)..(604): a, c, t, g, unknown or other
tcagtcgatcacgtcacgaccggtgctcgatttagcacacgatagttgggtttgggggtccctgagactctcctgtgcagcctctggattcaacttcaaaattatgggatgcactgggtccgccaggctccaggcaaggggctggagtgggtggcaactatatcatatgatggaagttttaaagactatgcggactccgtgaaggccgattcaccatctccagagacaattccaagagcacactctattgcaaatgaacngctggganctgagacacggctgtctatacngtgacgaaacgaccggcctcgtagtgggtcggggtattangttcgnggggaccaggggaaccccttgggcccaaccggttctccccgtgaccgtccctaccgaacccgaaacggggccccctagtcccgggttccctccccccgtggcccgtcccctggccctaaccgaggggacccnccctaccgccgagcgaccacgcggcccgggtccgcgggacctcgaccgttcggaccgaacggtcctaccgttccgacgtcgacgtccgacgtcggcggccggtacgcggacgacggccganaacgttacgncncnn

SEQ ID NO: 404407 - DNA, 673 bp, Homo sapiens
  misc_feature: GZ8MTXP02J1TS5.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgacgactctcctgtgcagcctctggattcaacttacaaaaattatgggatgcacgtcgggtccgcacggctccgaggcgaaggggctgggaggtgggtgacaactatatcatatagatggtaaagtttagacttagtcgacggtacctccgtagaacgggccgtattccaccgattcctacccgagacgaactaaacttaccgaaagacgaccaactactacttaagtttagaacctaaaagtacgaaacgtacggtacccggtaggggaacgtaccgtagggaacgggaacccgtaacgggtccgttacggttaaacccgttaagtttaccgtacgggttacggtaaaccgtaaaaccgggtaacccccgggtacccttacggttaacgggtttaccgggggtacggggggttaactttacgggg

SEQ ID NO: 404408 - DNA, 673 bp, Homo sapiens
  misc_feature: GZ8MTXP02JXQZ9.38.35.D02.1.454.CMB.2.raw
  modified_base (289)..(289): a, c, t, g, unknown or other
  modified_base (308)..(308): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagctctcctgtgcagcctctggacttcaacttacaaaattntgggatgcacgtgggtccncgtaggcctccgaggcgaaggggctgggagtgggtggacaacgtatactcatatagtatggtaaagtttttaaagcttaagtcggaccggtactacccggttaggaacggggtcccgtaatttaccgaaccctataccctacccgaggaagaaccaaactttaccccaaagacgacaacctactccttaatttcggaacctaaaatacgaaacgtacggacccgtaggggacgaccgtaggaacggacccgaacggggcctttcgggttacccttaagtttaccgtagttacggaaaccggaaaacggtaaaccccggtccccttacggtaggttacggggggttccgggtaaaggtttaccggg

SEQ ID NO: 404409 - DNA, 647 bp, Homo sapiens
  misc_feature: GZ8MTXP02ITLJK.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgacgactctcctgtgcagcctctggattcaacttacaaaattatgggatgctacgtgggtccgccgacggcctccgaggcgaaggggcgtgggaggtgggtggcaaactagtactacatagtgtaagttaggttaaagtttaagacttaagtcggtaccgtaccgttaccggtagggaacggggacccgtatttcccgaacctattaccctaccgtaagaacgaactaaacgttaccaaagacgaccaaacctacttacttatttacgaactaaatagaaacaggaccgtagggacgtacgtagacggacgacggtcttacgtacgttaacttacgtcgtacggaacgtaaacggacccgtacccgttacgtaggtcggggtaccggggtagtttacgg

SEQ ID NO: 404410 - DNA, 673 bp, Homo sapiens
  misc_feature: GZ8MTXP02H5WAY.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagctctcctgtgcagcctcgtgattcaacttacaaaaattgtgggatgcacgtcgggtccgccgaggcctccgaggacgaaggggctgggaggtggggtcggacaaactatactcaatagtagtagttaggttaaaatttttaagacttaagtcggacggtactccggtaggaacggggtccgtaatccgaacctactccgtaccgagaacgaactaacttaccgaaagacgacctaaactaccttactttaatttacgaactaaagtacgaaaccacggtaccggaggggtaacgcgtacgggaacggtaccgaacgggtcttacggttacttaacgtttaccgaggttacggaaccggtaaaacggtaacccccggtacccgttacgtaacgggttacgggggtaccgggggttaagtttcgg

SEQ ID NO: 404411 - DNA, 538 bp, Homo sapiens
  misc_feature: GZ8MTXP02FSH7Y.38.35.D02.1.454.CMB.2.raw
  modified_base (466)..(466): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttacaaaaattatgggatgcactgggtccgccaggctccgaggcgaaggggctggaggtgggtgcaactatatcatatgatggtaagttttaagactatgcgactcggtagaacgggccgattccaccatctccagagacaattccaaagagacacactctatttgacaaatcgaacagccgtagggancgtgacggacacggctgtctattactgtgacgaaacgacccggccctcgtagtcggggtacgggagtttacg

SEQ ID NO: 404412 - DNA, 725 bp, Homo sapiens
  misc_feature: GZ8MTXP02FOOTG.38.35.D02.1.454.CMB.2.raw
  modified_base (264)..(264): a, c, t, g, unknown or other
  modified_base (269)..(269): a, c, t, g, unknown or other
  modified_base (291)..(291): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccgtgggggtccctgagactctcctgtgcngcctntggattcaacttacaaaaattntgggatgacacgtgggtccgcgaggcctcgaggcgaaggggctggaggtgggtggacaactatactcatatagattaggtaaagttttaagactatcggacggtactccggtagggaaacgggtaccgtacttaccgaaccctacgtacctacccgaacggaacgtaacctaaacgttaccgaaaacgacgaacctaacctaacttaccttaacgttttacgaactaaaacgttacgaaacgtaacggacccggtaaggggacggtacgtacgggaacgggaaccgtaccgggtacgttaccgggttaacttaaccgtttaccggtaggttaaccggtaaaaccggaaaaccgggtaaacccccgggtaccccgtttaaaccgggttacgggtttaccggggggtttaccgggggttaaggttttaaaccgggg

SEQ ID NO: 404413 - DNA, 694 bp, Homo sapiens
  misc_feature: GZ8MTXP02JVEQ8.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctgggtggagtcgtgggggagtcgtggtccaggccgtgggggtccctgacgctctcctgtgcacgcctcgtggattacaacttacaaaaattgtgggatcgctacgtcgggtccgccgaggcctaccgagggcggaacggggtcgtggggaggttggggtacggactaaacttagtactactaagttagtagtaagttagggttaaaagttttaagacttagtcggaccggtaccgtacggtagggaacgggtaccgtacgttaccaccgtactacctaccgaagacgtaacctaacttaccgaaacgtacgaccaactaccttacttaatttacgaactaaacgtacgaaacgacgtaccggtagggacgtacgtacggaacggtacgtacggtcgtacgttacgttattaccgtaggtacggaaaccggtaaaccggaacccggtacccgtacggttacgggtacgggggttacggggtagtttacggg

SEQ ID NO: 404414 - DNA, 595 bp, Homo sapiens
  misc_feature: GZ8MTXP02IGQZU.38.35.D02.1.454.CMB.2.raw
  modified_base (293)..(293): a, c, t, g, unknown or other
  modified_base (501)..(501): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccagccgtgggggtccctgagactctcctgtgcagcctctggattacaaacttacaaaaattntgggatgacacgtcgggtccgccgaggcctaccgaggcgaaggggcgtgggaggtggggtgacaaacgtatacgtcatatgaagttaggtaaattttagacttagtgacgtactcggagtacgggcctatccacatctaccagaagactaactaccaaagacacaactacttacttaattgaactaaatgaaactagccgtagggacncgtagacggacgtacggtctacgttacttacttacgtcgtaacgaacgaaaccgtacccgtccgtacgtaggttcggggtacgggttagttacg

SEQ ID NO: 404415 - DNA, 704 bp, Homo sapiens
  misc_feature: GZ8MTXP02JD856.38.35.D02.1.454.CMB.2.raw
  modified_base (293)..(293): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgacgacctcccctgtgcagcctctggattcaacttacaaaaattntgggatgcacgtggggtccgcacggctccgaggcgaaggggctgggaggtgggtggcaactatatccatatgataggtaagtttaaagcttagtcggacggtacctaccgggttaggaaacggggcccgtaactttaccgaaccctacgttacccgtaccgtaacgaacgaacctaaacgtttacccgaaaaggtacgacctaaacctaacctttacttaacttttacggaaccttaaaagtacgaaaccgacggtacccggttaggggacgtccgttagggaacggtaaccgtacggtacttaggttaccttaacgtttaaccgtggttacggaaccggtaaaacggaaccccgggtcccttaacggttacgggttcgggggttacgggggtacggtttagtttacgggg

SEQ ID NO: 404416 - DNA, 628 bp, Homo sapiens
  misc_feature: GZ8MTXP02JDIQI.38.35.D02.1.454.CMB.2.raw
  modified_base (518)..(518): a, c, t, g, unknown or other
  modified_base (521)..(521): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctgggtggagtcgtgggggagtcggtggtccaggccgtcgggggtccctgagactctcctgtgcacgcctgtgattacaaacttaacaaaattgtggatgaccgacgtcgggtcccgaccgacggtccaccggaggacgggacgggtcgggtaggtaggggttagggcggaacctaaagtactaccgtataagtagtaaggtaggttaaaggtttaaagttagtacgtagtacggtaccgtacgtacggtacggacgggactacgaccactactcacgaagacaactactacagacacactactattatacaanaanacgacgacgtacgagcgagagacgacgtcgatacgtattacgtacgtacgaacgaaccgaaaccgtaccgtaccttaggtacggggttacggtacggggttatcggg

SEQ ID NO: 404417 - DNA, 648 bp, Homo sapiens
  misc_feature: GZ8MTXP02HVXAX.38.35.D02.1.454.CMB.2.raw
  modified_base (262)..(262): a, c, t, g, unknown or other
  modified_base (444)..(444): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaaggccgattcaccatctccagagacaattccaagagcacactctatttgcaaatgaacagcctgganctgaggacacggctgtctattacgtgtgacgaaagacccggcctgtagtggggtcgggattagtgtcgtggggacccaggggtaacccctgggacccaccgtctcctcacgccctccaaccgaacgggccccagttccggtcctttcccccgtgggcccgtccctgccctacccgagggacncccgtaccctccggagacgccaacgtcggccggtccccgtggggacctcggcccgtagggtacccaaacgggtacctttaccgttccgaaccggttgaacgtttcccgggaacgttcgggaaaccggggccgggggtaccgttacggggaacccgaaaaggggtccccggcctaaaacggttaggccgacgtcgacgcgacgcg

SEQ ID NO: 404418 - DNA, 718 bp, Homo sapiens
  misc_feature: GZ8MTXP02IWW76.38.35.D02.1.454.CMB.2.raw
  modified_base (270)..(270): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccaggccgtgggggtccctgagctctcctgtgcagcctgngattcaaacttacaaaaattgtgggatgacctacgtcgggtccgccgaggcctaccgaggcgaaggggctgggaggtggggtaggacaaactatactacattagtagtaagttagggttaaaagttttaacgacttagtacggtaccggtaccgttccgggtagggaaacccggggtcctaacgtttacccaaccgtacgtccctaccgaagactaaacgtaaccttaacccgaaaggaccgaaacctaacctaaccttactttagtttacggaaacctaaaattacgaaacgtacggtcccggtaaggggacgtaccgaggggaaccggaaacgtaccggtcgttacgttacgtttaacgtttacgtacggtaccggtaaaccggaaaaccggtaccccggtaccgttacggttacgggtacgggggttaccgggttaagtttcggg

SEQ ID NO: 404419 - DNA, 717 bp, Homo sapiens
  misc_feature: GZ8MTXP02I5SI9.38.35.D02.1.454.CMB.2.raw
  modified_base (351)..(351): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggaggtcgtgggggagtcggtggtccaggccggtgggggtccctgacgctctctgtgcagcctctggatcaacttacaaaattatggatcgacacgtcgggtccgcgaggcctaccgaggtacgaaggggctagggaggtgggnggactaaacgtatacgtcaatagtagtaagtagggttaaaattttaaagaccgttaagtacgggtaccggtaccgtaccgggtacgggaaacggggtacccgtaagttacccacccgtaactacccgtacccaaagtaccgtaactaaacttaacccgaaaagacgaaccaaacctaaccttactttaactttacgaactaaaacgtaacgaaacgtaaccgaccggttagggaacgtaccgtaaggtaacggtaaccgacggtacctacggttacttaaacgttacgtaggttaacggaaacgtaaaaccggaacccggtacccgttacggtacggtacggggtacggggtttaacgtttaacgg

SEQ ID NO: 404420 - DNA, 569 bp, Homo sapiens
  misc_feature: GZ8MTXP02FG8SA.38.35.D02.1.454.CMB.2.raw
  modified_base (475)..(475): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccaggccgtggggggtccctgagactctcctgtgcagcctctggattcaacttacaaaaattatgggatgcacgtgggtccgccaggctccgaggcgaaggggctgggaggtggggtggcaactagtactcatatgataggtaaagttttaagactaatgcggactcggtgaacgggccgattcacatctccagagacaattccaagacgacacactctattgacaaatgaaacagccgtagggacncgtagaaggaccacgggcctagtacctagttaccgtgtacgaaccgaaaacggaacccggtcctacgtagtagggggtaccgggtagtttacgg

SEQ ID NO: 404421 - DNA, 648 bp, Homo sapiens
  misc_feature: GZ8MTXP02GPD0X.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaaacttacaaaaattagtagggatgcacgtcgggtccgccgaggcctccgagggcgaaggggctgggaggtggggtggacaactagtactcagttatagtagttaggttaaagtttttaaggacttagtacggaccggtacgtcccggtaggaacggggtacccgtacttaccgaccctactccctaccgaacgaacgaacctaaacttaccgaaagacgaccaactactacttatttagaacctaaagtacgaaacgacgccgtagggagtccgtaggaacggaccgacggcttacgttactacttaccgtggttacgaacggaaacgacccggtaccgtacgtacgggtggggttacggggtagtttacgg

SEQ ID NO: 404422 - DNA, 684 bp, Homo sapiens
  misc_feature: GZ8MTXP02HDF31.38.35.D02.1.454.CMB.2.raw
  modified_base (347)..(347): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggatcgtggtccagccgtgggggtccctgagactctcctgtgcagcctctggattacaacttacaaaaattgtagggatgcacgtcgggtccgccaggcctccgaggcgaaggggctagggaggtggggnggtacaaactatacgtactaatagtagattagggtaaaagtttttaagacttaagtcggacgtaccgttaccggtagggaaaccgggtacccgtaacgttaccaacctactccgtacccaaaggaacgaactaaacgttacccgaaaagacgaccaactaccgtactttaatttagactaaaatcggaaaacacggtacccgtaggggaactcgaaggacggaaccaccgggtaccgttcgttaacgttaccgtagtacgaccggtaaaaccggaaacccggtaccccgtacggtaacggttaccggggtacgggggttacggttagtttaccgggg

SEQ ID NO: 404423 - DNA, 848 bp, Homo sapiens
  misc_feature: GZ8MTXP02HTQW3.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcggtggtccagccggtggggggtccctggacgacttctccgtggtcgcgacgtccctcgtggtacttaccaaaccttaactaaaaaaattgtagggtaattcggacctacgtcggggtccccgaccgacggcctccgaggccggaaggggcgtagggaggtcggggtaggacaaacgtatactacatagtagtagtaggttaaaagtttttaagaacgttagtacggtaccggtaaccgttccggagggaaaccggggtaccctaaacgttacccaacccgtactttaccccgtaaccgaaacgggacgtaaaacccttaaacgttaacccgaaaacgtaacgaacccaaaccgtacctttaaaccttttagtttaaccgaaaacctaaaaaggttacgaaaaaacccgtccggggtaacccggttaagggggaaccgtacccgggttaaaaggggaaccggaaaccccggtaaccgggggttctttaaaccggttaccgttaaacgtttaaccggtcggtttaaaccgggaaaacccggttaaaacccggggtaacccccggtaacccgtttacggggtaaacggggtttccgggggtaaccggggtttaagtttaaccgggg

SEQ ID NO: 404424 - DNA, 734 bp, Homo sapiens
  misc_feature: GZ8MTXP02GG5ZD.38.35.D02.1.454.CMB.2.raw
  modified_base (639)..(639): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagctcttttaagaggtgtccagtgtcagatgcagctgggtggagtcggtgggggtagtcggtggtccgaggtcccggttcggggggtccctggacgtaccttcctccgtgtcgcacgccctcgtaggacttacaaacttactaaaaaatttgtagggaactgacacggttcgggtccgccgaggtcctccgagggcgaaggggtctaggggaggttggggacgactaaactatacttcaatagtagtaagttagggttaaagtttttaagacttaagtacgggaccggtaccgtccgggtaagggaaccgggtcccgtacttacccaaccgtacgttaccctacccgaaagtaaccgaacttaaacctacccgaaaagaccgtaacctaacctaactttacttaagtttacgaaactaaaacgttacgaaaccgtacggtccggtaaggggaccagtacggacggaaacncgggttaatcggttaccttagttaccgcggtaacggaacgaaaacccggtcccgtacgttacggtacggtacggggtaccgggttagtttacggg

SEQ ID NO: 404425 - DNA, 639 bp, Homo sapiens
  misc_feature: GZ8MTXP02F7FHD.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtgcagcctcgtggtattcaaacttacaaaaattgtagggaatgcacgtcgggtccgcgaggcctccgaggcgaaaggggcctagggaggtgggtagactaaactagtacctcatatgtagtaggtaaattttaagacttaagtagaccgtacgttccggtaggtaacgggcccgtattaccgacctatcctacaagacgaactaacttaccgaaagacgacctaaccaccttacttatttacgactaaaacgtacgaaaccgaacgtccgtaggggactccgtagggaacggacgaaccggtcgttagttactaacttacgtgtacggaacggtaaacgaacccggtcctacgtagtcggggttacgggtaagtttcgg

SEQ ID NO: 404426 - DNA, 586 bp, Homo sapiens
  misc_feature: GZ8MTXP02JELAQ.38.35.D02.1.454.CMB.2.raw
  modified_base (290)..(290): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagccctctggattcaacttcaaaaattngggatgcacgtggtccgccaggcctcgaggcaaggggctgggacgtgggtgacaactatacgtcatatgataggtaaatttagctaagtgacgactcgaggaacgggccgtattcgacctatctaccagacgaacaacttaccaaagtacgacacctactaccttaatttcgaactaaagtacgaaactagacccgtaggagacgtagaacggacgacgggacctacgtacgttacgtacgtacgacgaacgtaaccggaccctacgtacgtagggtccgggtacgttagttacgg

SEQ ID NO: 404427 - DNA, 641 bp, Homo sapiens
  misc_feature: GZ8MTXP02FYPSO.38.35.D02.1.454.CMB.2.raw
  modified_base (290)..(290): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtgggggtccctgagactctcctgtgcagcctctggattcaacttacaaaaaattntgggatgcacgtgggtccgccaggctccgaggcaaggggctagggagtgggtgcaacgtatactcatatgataggtaatttaagctagtgcgtactccggtagaaacgggccgtattccaacccagtcctacccgaagacgaactaaacttcccgaaagcgaccactaacctacttaatttcaacctaaaagttcgaaacgtaacggtcccgtaggggtacaccgtaggaacggtaccgaaccggtaccgttgttacttaacgtttacgtacggtcgaaaccggaaaaccggtacccccggtacccttacggtacggttacgggggttaccggggtaacgtttttaacggg

SEQ ID NO: 404428 - DNA, 680 bp, Homo sapiens
  misc_feature: GZ8MTXP02F92VX.38.35.D02.1.454.CMB.2.raw
  modified_base (551)..(551): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcttttaagaggtgtccagtgtcagatgcagctggtggagtcgtgggggagtcgtggtccaggccgtgggggtccctggagactatccgtgtgcagcctctggtattacaaacttacaaaaaattagtagggatgacacgttcgggtccgccgaggcctacccgaggccgaaaggggccgtagggagggtgggtggacaaacgtatatcataatgtaagttaggttaaaactttttaaagacttaagtacgggaccgtaaccgttaccgggtaggaaacggggtacccgtaattacccgaacctaacttccctacccgaaaggaactaactaaaacgttacccgaaaagacgacaaacctaacttacttacgtttanaaacctaaaattacgaaacacgaccgtaggagtacgaggaacggaccgacggtaccgtgtacttattacgtagtacgaacgaaaacgaccccgtacctacgtaaggtacggggtcggggtaatttacgg

SEQ ID NO: 404429 - DNA, 674 bp, Homo sapiens
  misc_feature: GZ8MTXP02FU9L5.38.35.D02.1.454.CMB.2.raw
  modified_base (292)..(292): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctggagctctcctgtgcagcctctggtattcaacttacaaaaattntagggatgcacgtcgggtccgccgaggcctccgaggcgaaggggctgggaggtgggtggacaaacgtatatacaatatagtagtaaggttaaaagtttttaagacttaagtaggtaccggtaccgttccggtaagggtaaacgggcccgtaagttacccaaccctaacttcctaacccgaagaacgtaactaaacttaccgaaaagacgaccaacctaccttacttagtttacaactaaaatacgaaacacggaccgtagggagcgtaggaacgggactacggtcttacggttaccttaagttaccgtagttacggaaaccggaaaacggtaccccggtccccgttaagtacgggttcgggggtacggggttagtttacggg

SEQ ID NO: 404430 - DNA, 647 bp, Homo sapiens
  misc_feature: GZ8MTXP02IUYBE.38.35.D02.1.454.CMB.2.raw
  modified_base (292)..(292): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccaggccgtgggggtccctgagctctcctgtgcagcctctggattacaacttacaaaaattntagggatgcacgtcgggccgccaggcctccgaggcgaaggggctgggaggtgggtggactaactatactcatatgagtaggtaaagttttagactagtcgacgtacgtcggaggaacgggccgtattccgacctatcctaccaagacgaactaactaccaaagacacaactacttactatttacgactaaaacgtacgaaacgtacgtccggtaaggggacgtaccgtgggaacggaaccggacggtccttacggtttacttaagttaccgtaggttaacgaaacccgggtaaaacggtaaccccggtcccgttacggtaacgggttacgggggtaccggggttaggtttaacgg

SEQ ID NO: 404431 - DNA, 694 bp, Homo sapiens
  misc_feature: GZ8MTXP02HGDR6.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagctctcctgtgcacgcctctggacttacaacttacaaaaattagtagggatgcacgtcggtccgcgaggctccgaggacgaaggggcgtggagtgggtcggactaacgtatactctaatagtggtaagttagggttaaagtttttaaagacgtttaatacgggtaccgggaacccgttcgaggggtaaaccgggggccgtaattacccgaacctacgtcctacccgaagaacgaactaacttaccgaagacgaccaaccaacttcttaactttagaactaaagtacgtaaacacggaccgttaggggacgtccgtaaggacggaacgaacgggtcttcggttacttaaacgttacgtacggttacggaaaccggtaaaaccggtaacccggtacccggttaccggtaagggtacccgggggttagggggttaaccgtttacggg

SEQ ID NO: 404432 - DNA, 590 bp, Homo sapiens
  misc_feature: GZ8MTXP02FT2LD.38.35.D02.1.454.CMB.2.raw
  modified_base (266)..(266): a, c, t, g, unknown or other
  modified_base (454)..(454): a, c, t, g, unknown or other
  modified_base (585)..(590): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagccgtggganctagaggacacggctgtcttatactgtgacgaaacgacccggcctctagtggggtcgggtagttagtcggtcgtcggggcccgtaacggggtaccctcggccccaccgtctcccgtcacgccctccgaccgaacgggccctacgttccgtccctcccccgtcggcccgtccctgccctaccgaggacncccgaccgtccgaagacgaccacgacggcccggcccgtgggcctcggcccgttggtaccgacggtacctacgttccgacgttgacgttcgacgtggacggcggggactcgggacgaacggccagaagtgcnnnnnn

SEQ ID NO: 404433 - DNA, 684 bp, Homo sapiens
  misc_feature: GZ8MTXP02HKRXO.38.35.D02.1.454.CMB.2.raw
  modified_base (293)..(293): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccagccgtgggggtccctgagactctcctgtgcacgcctgtggattacaacttacaaaaattntagagtatgacacgtcgggtcccgccaggcctccgaggcgaaaggggctagggagtggggtgctaacgtatatcatagtagagtagggtaagtttttaaagactagtcgacgtaacgttccggtagggaaacgggtcccgtaacgtttacccaacctacgttcctaccgaagaacgtaaacctaaacttacccgaaaagacgaccaactaaccgttcttaacgttagtaaaccaaagttaacggaaacgtaacgccggttaaggggaccgtaccgtagggaaacggaaccggtacccggtagtttaccggtacttaacgttaccgttgggaacgtaaccggaaaacggtaaccccggccttaacggtacggtcgggggttacgggttaagg

SEQ ID NO: 404434 - DNA, 716 bp, Homo sapiens
  misc_feature: GZ8MTXP02GEC6D.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattagtgggatgacacgtcgggtccgccaggcctaccgaggcgaggggctgggagtgggtgacaacgtatactcatatgagttaggtaaagttttaagacttaagtcggtaccggacgtaccggtaggaacggggtacccgtagtttacccaacctaacttaccctacccgaaaggaccgtaaacctaaacgttaccccgaaaaggacgacccaacctaaaccttaccgttaagttttacgaacctaaaagttacggaaaccaaggtccccgtagggggaacgtccgtagggaacggaaccgtacggggtacttacgggttaactttaacgtttaacctggtaacgtaaaccccgggtaaaaacgtaacccccgggtaacccgtttacgttacgggttacgggggttaaccggggtagttttaacgggg

SEQ ID NO: 404435 - DNA, 556 bp, Homo sapiens
  misc_feature: GZ8MTXP02FI2RH.38.35.D02.1.454.CMB.2.raw
  modified_base (362)..(362): a, c, t, g, unknown or other
  modified_base (550)..(552): a, c, t, g, unknown or other
  modified_base (554)..(556): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacagcctgggagctggaggacacggctgtctattactgtgacgaaagaccggccctctagtggggtcgggagttatggtcgtggggccagggaaccctggcccaccgtcncctcacgccctcccaccgaaacggggcccacgtccggtcctcccccgtggcccgccctcgcctccgaggacgccacccgtccgagacgccacaggccggcccgtgggctcgccgtggccgaaaggctacgttcccacggtgacgtcgactggaggccgggtcgcggcgaacgggcccgagaagtagcnnncnnn

SEQ ID NO: 404436 - DNA, 685 bp, Homo sapiens
  misc_feature: GZ8MTXP02G6DYV.38.35.D02.1.454.CMB.2.raw
  modified_base (580)..(580): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagcgtggtggagtcgtgggggagtcggtggtccaggccgtgggggtccctgacgtactcctccgtgtcgcacgcctcgtggtacttacaaacttactaaaaaattgtagggatcgactacgtcgggtaccgccaggctaccggaggcgaacggggctaggggaggtggggtacggactaaacgttacgtactacaattagtagtaagttaggtaaaagtttttaaacgacttaagtacggaccgtaccgtacggtagggtaaaccgggaccctaagttacccaaccgtactaccgtacccgaaagactaactaaacgtacccaaagacactaactactacttagttacaactaaaagtacgaacacgacgtagggacncgtaagacggaacgcggtctactacttacgtaccgtataacggaaccgtaaaaccgaccccggtcccgttacggtaggtaccggggttacggggtagtttacggg

SEQ ID NO: 404437 - DNA, 619 bp, Homo sapiens
  misc_feature: GZ8MTXP02IFP2E.38.35.D02.1.454.CMB.2.raw
  modified_base (367)..(367): a, c, t, g, unknown or other
  modified_base (394)..(394): a, c, t, g, unknown or other
  modified_base (471)..(471): a, c, t, g, unknown or other
  modified_base (519)..(519): a, c, t, g, unknown or other
tcagtcgatcacgtcacgaccggtgctcgatttagcacacgatagttgggtttggggagctctgggagaggagcccagcactagaagtcggcggagtttccattcggtgataagcactgaacacagaggactcaccatggagtttgggctgaactgggttttcctcgtagctcttttaagaggtgtccagtgtcagatgcagctgggtggagtcgtgggggagtcgtggtccaggccgtggggggtcccctggagtactcttcctgtgcagcctctggattcaaacttcaaaaattatgggatgcaccgtgggtcccgcctaaggctacccgaggcaaaggggctgggagtgggtggcaacgtatanccgataatgataggtaaagttttaaanacgttagttgacggtactaccggtggaacgggcccgtattcaacctaatcctaccaagagaacaaattaccaaaganacaacacttcttaatttgaactaaagtcgaaacagtaccgtagggganctagaacggtacaacggtctagtcttaatacgttagacgaacgaaaacggtaacccggacccttagtacggtacgggggtacgggtagtttaacgttcgg

SEQ ID NO: 404438 - DNA, 620 bp, Homo sapiens
  misc_feature: GZ8MTXP02JA7EC.38.35.D02.1.454.CMB.2.raw
  modified_base (518)..(518): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtcgcagcctctggacttcaaacttacaaaaattagtgggaatgacacgtcgggtccgcccgaggcctacccgaggccgaaaggggccgtggggaggtggggtcggaccgaaactatactctaatatagtagttaaggtaattttaagacttagtcgtaccggactaccgggtagaaacggggcctaagtccactacgtctacccaagacaacgtaactacccgaaagacgacacgactactattagacaaatacgaanacggccgagggacgactaggaacgtacgacggtctcggtactacgttctagacgtaacgaaacgacccgtccgtacgtaggtcgggtacggggtatttacgg

SEQ ID NO: 404439 - DNA, 584 bp, Homo sapiens
  misc_feature: GZ8MTXP02F53J9.38.35.D02.1.454.CMB.2.raw
  modified_base (455)..(455): a, c, t, g, unknown or other
  modified_base (481)..(481): a, c, t, g, unknown or other
  modified_base (570)..(570): a, c, t, g, unknown or other
  modified_base (578)..(578): a, c, t, g, unknown or other
  modified_base (580)..(584): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgacaaatgaacagcctgggagctgaggacacggctgtctattactgtgacgaaacgacccggccctcgtagtggggtcggggtagttagtcggtcgtcggggccgaacggggtaacccgtcggcccaccggtcctccgtcacgccctccgacccgaacgggccccagtccggtcccttccccctgggcccctccctgccctccgagggccncccacccgtcccggaagctaccgacncgggcccggcccgtgggcctcgccgtggaccaacggtcttcgttcccgacgtgactcgactggacgcggggactcggcgaaacgccganaagtacgncnnnnn

SEQ ID NO: 404440 - DNA, 810 bp, Homo sapiens
  misc_feature: GZ8MTXP02IC0HQ.38.35.D02.1.454.CMB.2.raw
  modified_base (246)..(246): a, c, t, g, unknown or other
  modified_base (259)..(259): a, c, t, g, unknown or other
  modified_base (261)..(261): a, c, t, g, unknown or other
  modified_base (267)..(267): a, c, t, g, unknown or other
  modified_base (307)..(307): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagcgtggtggagtcgtgggggagtcgtggtcaggcgtgggggtccngacgctctctgcncncgctcngattacaacttacaaaatagtggatgctacgtcgggtccncgacggctaccgaggacggaggggcgtggggaggtcggggtacggactaaacgtagtactactaagtagtagtaagttaaggttaaaacgtttttaagaccgtttaagtacgggaccggtaccgttaccggggagggtaaaccgggaccccgttaatacccgtaaccctacgtttacccgaaccgaaaacgtaaaccggtaaaccttaaaaccgttaaacccaaaacgggactaaacctaaaccctttaaccttaaccgtttttaaggtttaaacccaaaggttaaaaacttcggaaaaaacccggtcggttacccgggagggggttaacaacccgggttaaggggaaaccggtaaaaccggtcccgggtttaaacgttcggtttaaaccttaaaacgtttccggtaggtttaaccggaaaccggtaaaaacccgggtttccccgacccgtttaaccgggttacgggggttacgggggttaaccggggttaaggtttccgggg

SEQ ID NO: 404441 - DNA, 755 bp, Homo sapiens
  misc_feature: GZ8MTXP02HS2YY.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccaggccgtgggggtccctgacgactcgtcctgtcgcacgtcctgtggtacttacaaacttactaaaaaattgtacgggtatcgtactacgtcgggtccggccagggtcctacccgaggccggtaaaggggtccgtaggggtacggtggggtacggtaccgaaactttaactaccgtacgaagttagtaggtagtttaggggttaaaactttttaacgggaccttaaggtcggtaacccgggtaacggttcccggtaaaggggtaaacggggtacccgtaagtttacccaacccgtacgtacccttaaccgaacggtaaccggtaacttaacgttacccgaaagtacgacctaactaccgttactttaagttcgaactaaagtacgaactacggtccgtagggaactcgtaggtacggtacgtacggtcgtcgtaaccgtttacgtacgttcggtacgtaaccggtaaacgtaccccggtaccgtttacgacgggtttaccggggtacggggtttacgtttaacggg

SEQ ID NO: 404442 - DNA, 751 bp, Homo sapiens
  misc_feature: GZ8MTXP02I0MBT.38.35.D02.1.454.CMB.2.raw
  modified_base (376)..(376): a, c, t, g, unknown or other
  modified_base (654)..(654): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctgtagctcttttaagaggtgtccagtgtcagatgcagctgggtggaggtcgtgggggatcggtggtccaggtccggttcggggggtcccctggacgtaccttctcctggtcgcacggccctgtggtacttaccaaacttactaaaaaagttgtagggatcgactacgttcgggtcccgcgaggcctaccgaggacggaacggggctaggggnggtggggtagacctaaacgtataccgtacattagtagtaagttaaggttaaacgttttaaggactttaaaggtcggtaaacccgggtaccgtttaccgggggtaaagggtaaccgggggacccgttaactttacccaacccgttacttacccgaccgaaacgtaacgtaacctaaacttacccgaaacgaactaccctaaaccttactactttaagttacggaactaaaacgtaacgaacgtaccggacgtaacggggcaacggtagaacgggtaacncggtccgttagtacttacgttacgcggttaaccggaaacgaaaccggtaccccgtaccgtacggtacggttaccgggggttacggttaggtttccgg

SEQ ID NO: 404443 - DNA, 610 bp, Homo sapiens
  misc_feature: GZ8MTXP02FISMF.38.35.D02.1.454.CMB.2.raw
  modified_base (360)..(360): a, c, t, g, unknown or other
  modified_base (453)..(453): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtgcagcctctggattcaaacttacaaaaattagtgggatgacacgtcgggtccgccgaggctccgaggcgaaggggctgggaggtggggtgctaaacgtntactcatatgactaggtaaattttaagactaatggacgtacgtacgtagaacgggccgtattaccgaccatctaccagagactaatccaaganacacatccttaagttcactaaatcaaacgagtccgtagggacgtcgtagggaacggaccaacgggtccgttaggtaccttaagttaccgtaggtacggaacgaaaacgtacccggacccgttacggtagggttcggggtaccggggtagtttacggg

SEQ ID NO: 404444 - DNA, 591 bp, Homo sapiens
  misc_feature: GZ8MTXP02H0QY1.38.35.D02.1.454.CMB.2.raw
  modified_base (478)..(478): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaaacttcaaaaattatgggatgcactgggtccgcaggctccgaggcgaaggggctgggaggtggggtggcaaactagtatcatatgatggtaaagttttaagacttaatgcggactccgtagaaacgggcccgagttcaccatcctcagagacaattccaagagcacactctatttgacaaatagaacacgacgtggggaacncgtggaacggacgacgggcttggtacttaacgtttacgagttcggaacggtaaaacggaccccggtacccgttacgtaacggttcgggggttaccggggtaacggtttacggg

SEQ ID NO: 404445 - DNA, 603 bp, Homo sapiens
  misc_feature: GZ8MTXP02HRVCY.38.35.D02.1.454.CMB.2.raw
  modified_base (262)..(262): a, c, t, g, unknown or other
  modified_base (325)..(325): a, c, t, g, unknown or other
  modified_base (331)..(331): a, c, t, g, unknown or other
  modified_base (597)..(598): a, c, t, g, unknown or other
  modified_base (600)..(600): a, c, t, g, unknown or other
  modified_base (602)..(603): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaggcgattcacatctcagagacaattccaagagcacactcttatttgacaaatgaacagccgtggganctgagacacggctgtctatactgtcgacgaaacgaccgcctcgtagtggggtcggagtttagngtcggnggggaccgacggacccgtcggaccctaccgtctcctacaccgtcctcccaaccggaacggccctacgtccggtccccttccccgcgggaccctcccgtgccctcgacgggtccaccacccgtcgaacgcgaccacgttacggcccggtacccgtggggcctacggccgtggtaccaaacgggtccttaccgtccgaggtcgacgtccgaccggttaggacgggccggtcgttacgggaccgaacggggtccacgaaagtcggcgcnncncnn

SEQ ID NO: 404446 - DNA, 699 bp, Homo sapiens
  misc_feature: GZ8MTXP02F0FZ9.38.35.D02.1.454.CMB.2.raw
  modified_base (589)..(589): a, c, t, g, unknown or other
  modified_base (616)..(616): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcggtggtccagccgtgggggtccctgagtactctcctgtgcagcctctggtatcaacttacaaaattatagggatgacgacgtcggtccgccgaggcctaccgaggcgaacggggcgtggggaggttgggtggactaaacttagtactcgtaatagtagtaagttaacggttaaaagttttaagacttaagtcgggtacgtaccgttaccggtaagggtaaacgggtaccgtacgtttacccgaacctacctacccgttaccgtaaagaccgtaaactaaacgttaacccgaaagtacgaaccaaacctaccttaacctttagttacgtaaactaaaagtacgaaacgtacggtacccgtaaggggntaacggtcggaacggacgtaaccggtntacgttactacgttaccgtagtacggtaacgaaaccgtaaccccgaccgttacggtaggtaccgggttagggtacgtttacgg

SEQ ID NO: 404447 - DNA, 643 bp, Homo sapiens
  misc_feature: GZ8MTXP02ICLL4.38.35.D02.1.454.CMB.2.raw
  modified_base (270)..(270): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctggagactctcctgtgcagcctntggattcaacttacaaaaattatgggatgctacgtcgggtccgccgaggcctccgaggcgaaggggctgggaggtggggtgacaaactatactcatatgagttagggtaaagttttaagacttagcggacgtacgtccggtaggaacgggccgtatccaacctatcctacgaagacgaactaacttaccgaaagacgacacgtacttacttaatttacgactaaaagtacgaaacgtacggtaccgtaagggacgtacgtacgggaacggacgacggtcgttacgtaccttaagtttaccgtggttaacgaaccggaaaaccggtaacccggtcccgttacgttacggtcgggggttaacgggtagtttacgg

SEQ ID NO: 404448 - DNA, 603 bp, Homo sapiens
  misc_feature: GZ8MTXP02FYTIV.38.35.D02.1.454.CMB.2.raw
  modified_base (226)..(226): a, c, t, g, unknown or other
  modified_base (237)..(237): a, c, t, g, unknown or other
  modified_base (270)..(270): a, c, t, g, unknown or other
  modified_base (402)..(402): a, c, t, g, unknown or other
  modified_base (452)..(452): a, c, t, g, unknown or other
  modified_base (458)..(458): a, c, t, g, unknown or other
  modified_base (552)..(552): a, c, t, g, unknown or other
  modified_base (576)..(576): a, c, t, g, unknown or other
  modified_base (597)..(598): a, c, t, g, unknown or other
  modified_base (600)..(600): a, c, t, g, unknown or other
  modified_base (602)..(603): a, c, t, g, unknown or other
tcagtcgatcacgtcacgaccggtgctcgatttagcacacgatagttgggtttggggggtccctgagactctcctgtgcagcctctggattcaacttcaaaaattatgggatgcactgggtccgccaggctccaggcaaggggctggagtgggtggcaactatatcatatgatggtaagttttaaagactatgcggactccgtagaagggccatcacatctcaganacatccaagancacactcttattgacaaatgaacagcgtggganctagacggacacggtctgtactattacgtggtgaacgaaacggacccggccctgtaggtcggggtacgggtatttagcggtcggtggggccaaccggggtacccgtcggaccctaccggttcctcccgtacncggcccctaccgaaaccgacggggtcccctacgtccgttcccctccccgnggcccncccgtcgcctacgacggctaccaccgtcgaagcgaccacgcggcccggtccgtggctcgccgtacggacaacggtccttacgtcacgtggtacncggtactcgggacggtcggaccgnggaaccgacggcgacacgtcnncncnn

SEQ ID NO: 404449 - DNA, 642 bp, Homo sapiens
  misc_feature: GZ8MTXP02H85ZG.38.35.D02.1.454.CMB.2.raw
  modified_base (264)..(264): a, c, t, g, unknown or other
  modified_base (270)..(270): a, c, t, g, unknown or other
  modified_base (481)..(481): a, c, t, g, unknown or other
  modified_base (537)..(537): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgacgactctcctgtgcncgcctntggtattacaacttactaaaaattgtagggatgcacgtcgggtccgcgacggcctaccgaggacgtaaggggctgggaggtgggtgacaacgtatactacatatagtagttaggttaaagttttagacttagtcggacgtacgtcggtaggaacgggccgtatacccgaacctactcccgtaccgagaacgtaactaacgtaacccaaganaccctactaccttgtttaattcggaataaacgttacgaaacgcgtacggtggaacncgtaaggaccgacgacggtctacggttactaagtttaccgaggttacgaaccggtaaaacgccccgtccttaggtaacgggtcgggggttacggtaacgtttcgg

SEQ ID NO: 404450 - DNA, 661 bp, Homo sapiens
  misc_feature: GZ8MTXP02F97FI.38.35.D02.1.454.CMB.2.raw
  modified_base (265)..(265): a, c, t, g, unknown or other
  modified_base (267)..(267): a, c, t, g, unknown or other
  modified_base (597)..(597): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcttttaagaggtgtccagtgtcagatgcagctggtggagtcgtgggggagtcgtggtccaggccggtgggggtccctggagctctctgtncngcctcgtgacttacaaacttactaaaaattgtgggatcgctacggtcgggtcccaccgagtccctaccgacgggcggaaggggtccgtagggagggttgggtcgactaacgtatactacatagtagagttaagggttaaaatttaacggacttaagtcgggtaccgtaccgttaccgggaaggaaccggggtaccgactttacccacctacgtcctaaccgagaaccgtaactaaacgttaccaaacgtacaactacctaacttctttaaagttagaaacctaaagtacgaaacacggtaccgtagggacgagtaggacgacggaccgtntacgtattactcgtaggacgaacgaaaccgccgtacctaggtggtacggggtacggtatttcgg

SEQ ID NO: 404451 - DNA, 767 bp, Homo sapiens
  misc_feature: GZ8MTXP02I0FNS.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctggagtctctcctgtgcagcctctgattcaacttacaaaaattgtaggatgcctacgtcggtcccgccaggcctaccgaggcggaacggggctagggaggtcgggtagcctaaagtatactacatagtagtaagttaaggttaaaagtttttaagacgtttaaatcgggtaccggtaaccgttacccgggtagggtaaaccggggtacccgttaattacccgaaccctaacgttaccccgtaaccgaaacggaaaccggtaaaccttaaaccgttaaccccaaaagggaccaccctaaaaccgttaccctttacctttaaagttttaccgaaacctaaaaagttcgaaaaccgtaacggcccggttaggggacacgtaacggtaacggtaacccggaccgggttacttacggttaacttaacggtttaaccgacggttaacggaaaccgggtaaaacccggtaacccggtaccccgttacggttaacggggtcgggggttacggggttaacgtttccggg

SEQ ID NO: 404452 - DNA, 722 bp, Homo sapiens
  misc_feature: GZ8MTXP02FH4HV.38.35.D02.1.454.CMB.2.raw
  modified_base (597)..(597): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccagccgtgggggtccctgagactctcctgtgcagcctctggtacttcaaacttacaaaaaattgtagggatgacacgtcgggtcccgccaggcctaccgaggcgaaggggctgggaggttggggtggactaaacgtatacgtaccaagtataggaattagggttaaaagtttttaagacttagttacggaccggtaaccttccggtaagggaaaccggggtacccgtaatttacccgaaccctattacccgttacccgaaacggacgtaaacctaaacgtttacccgaaaaggactaccaaaccctaaccgttactttaatttacgaactaaaagttacgaaaccaggaccccgttaggggaaccncgtagggaaacggtacgaaccggtcgttacgtacccgttaaagtttacccgtagtacgggaaaccgaaaaccgggtaccccgtacccgttaccgtagggtttcgggggaccgggtagttttacgg

SEQ ID NO: 404453 - DNA, 800 bp, Homo sapiens
  misc_feature: GZ8MTXP02FPAWF.38.35.D02.1.454.CMB.2.raw
  modified_base (264)..(264): a, c, t, g, unknown or other
  modified_base (294)..(294): a, c, t, g, unknown or other
  modified_base (313)..(313): a, c, t, g, unknown or other
  modified_base (334)..(334): a, c, t, g, unknown or other
  modified_base (384)..(384): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaagactatgcggactccgtgaagggccgattcaccatctccagagacaattccaaagagcacactctattgacaaatgaacagcctgggancgtagagacgacggctgtctataactggtnacgaaacgaaccggcctanagtcggggtcgggtattacgnggtaccgtggggaccaacggggtaccctgggaccctaccggtctaccctnaacgtcccctaccgacccgtaacgggggccccctaagttcccgggtcccgtttaccccccggggggttcccccgaccccctttcggacccgttacccggaaacgggggtaaaccccgtacccccgtaaccccggttaccggaaaccgggtaccggaacccgtaacccgggaccggggtcccccggggaccccgggttacgggggcccgttaccgggttaccccggtacggggtaaacccgaaaccgggttaacccgttacccgttacccggaacggttaccggtaccgtaacccggtaccggtacggggtaaaccggggtccggggttaaccggacgggggtaaaccccgggtaacgggacccgggttaaacgtaaacggttaccggggaactacgtacgtacgaccgtacgtacg

SEQ ID NO: 404454 - DNA, 559 bp, Homo sapiens
  misc_feature: GZ8MTXP02HRGGD.38.35.D02.1.454.CMB.2.raw
  modified_base (239)..(239): a, c, t, g, unknown or other
  modified_base (260)..(260): a, c, t, g, unknown or other
  modified_base (305)..(305): a, c, t, g, unknown or other
  modified_base (407)..(407): a, c, t, g, unknown or other
  modified_base (417)..(417): a, c, t, g, unknown or other
  modified_base (436)..(436): a, c, t, g, unknown or other
  modified_base (521)..(521): a, c, t, g, unknown or other
  modified_base (554)..(559): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactcgtgaaggcgatcacatctcagagacaattccaagagcacactctatttnacaaatgaaacagcctgggancgtgaggacacggctgtctattactgtgacgaaaagaccgccctntagtggggacgggtattagtgtgtggggccgaaggggaacctcggccaccgtctctcaggccctccaccgaaacgggccctagtccgggtcctttcccccgngggacccccnccctgccctaccgaggacnccaccgtacgagacgccacgtacggcccggtccgtgggcctcggccgtaggtacgaacgtacctaccgtaccgagtgacgcgacnggcggcgggcgacgacgacggtcgataagagcnnnnnn

SEQ ID NO: 404455 - DNA, 662 bp, Homo sapiens
  misc_feature: GZ8MTXP02HWZVY.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctggtggagtcgtgggggagtcggtggtccaggccggtggggggtccctggagctctcctgtcgcacgcctgtggacttacaaacttaacaaaaattgagggtatgacgtacgtcgggtcccgcgacggcctaccgaggaccgaaggggctaggggaggtggggtacgacaaacgttataccgtacaattgagtaagttaggtaaagtttaagacttaagtcgacgtactccggtaaggaccgggcgtattaccacgtacttcaccgaagaactaactaaacttacccgaagacgacaactacttacttattagaacaaatgaaacagccgtaggacgtcgagacggtaacgcgggttactacggttactaacttacgtacggtaacggaaccggtaaaaccggaaacccccggtcccgttaggtacgggttcgggggttaccgggttaggtttacgg

SEQ ID NO: 404456 - DNA, 676 bp, Homo sapiens
  misc_feature: GZ8MTXP02GI74M.38.35.D02.1.454.CMB.2.raw
  modified_base (270)..(270): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccagccggtgggggtccctgacgctctcctgtgcagcctntgactcaaacttactaaaattgtaggatcgacacgtcggccgccacggcctccgaaggcggaacggggcgtaggagggtgggtcgactaaactagtactacgaatagtaggtaagttacggttaaaagtttttaacggacttagtcggtaccgtaccgttaccgggtaggaacgggtaccgtacgttacccgacctaacgtcccgtacgaacgactaactaaacgtaccgaaagacacaaccttacttacttagttacaacgtaaatacgaaacgacgacggtagggatccgtagacgtaccgacgtcgttacgtaaccgttattaccggtagtaaccggaaacggtaaaacccggtacccggttaccctacgggttaggtaccgggggttacggtacgtttacgg

SEQ ID NO: 404457 - DNA, 585 bp, Homo sapiens
  misc_feature: GZ8MTXP02HW5MN.38.35.D02.1.454.CMB.2.raw
  modified_base (368)..(368): a, c, t, g, unknown or other
  modified_base (579)..(580): a, c, t, g, unknown or other
  modified_base (582)..(582): a, c, t, g, unknown or other
  modified_base (584)..(585): a, c, t, g, unknown or other
tcagtcgatcacgtcacgaccggtgctcgatttagcacacgatagttgggtttgggagactctcctgtgcagcctctggattcaacttcaaaaattatgggatgcactgggtccgccaggctccaggcaaggggctggagtgggtggcaactatatcatatgatggaagttttaaagactatgcggactccgtgaaggccgattcaccatctccagagacaattccaagagcacactctatttgacaaatgaacagcctggagctgaggacacggctgtctattactgtgacgaaacgaccggccctctagtggggtacggggagttagtggtcgtggggccaggggaaccctggcccaccgtctccncacgccctccgaaccgaaacgggcccctactcgggttcccttcccccgtgcccgcccgtcgcctaccgacggcgtccacccgtccgagacgcgaccacggccggccctgggggacctggtcccgtgggttaccgaacggtaccttaccgttccaccggttgacttacgacgtggacggcgggccgtcggcgaacggccgagtaacgagcgnncncnn

SEQ ID NO: 404458 - DNA, 763 bp, Homo sapiens
  misc_feature: GZ8MTXP02IXHGV.38.35.D02.1.454.CMB.2.raw
  modified_base (267)..(267): a, c, t, g, unknown or other
  modified_base (291)..(291): a, c, t, g, unknown or other
tcagtcgatcacgtcacgaccggtgctcgatttagcacacgatagttgggtttggggggtccctgagactctcctgtgcagcctctggattcaacttcaaaaattatgggatgcactgggtccgccaggctccaggcaaggggctggagtgggtggcaactatatcatatgatggaagttttaaagactatgcggactcgtgaggcgatcacatctcagagacaattaccaagagcacactctattgacaaatgaacagcctggganctgaggacacggctgtctattacngtgacgaaacgaacccggtcctcgtacgtcggggtacggggtagtttagtcgtcggtcggggaccgaacggggtaacccccgtcgggaccccgtacccgttccgtcccctacgaccgtccccgtaccccgaaacccgggaaccggggtcccccctaaggttcccccgggtttcccccttcccccccgtggggtcccccgtaccccgtcgggcccgttaccccggaacgggtacccgccctaaccccggtaccggaacgaccggtacccaaaccggtcccgggcccgggtccccggttaccgggggcttcccgggaccccgttggggtaacccgaaaggggttacccccttaaccgtttacccggacggttacgtacggttacccgtaacggttcggggaacgggaccggggtccggtacggggaaccggaaaacgggggtcccgaacgttaaacggtaacggcgcgcgcgcg

SEQ ID NO: 404459 - DNA, 693 bp, Homo sapiens
  misc_feature: GZ8MTXP02IOC83.38.35.D02.1.454.CMB.2.raw
  modified_base (266)..(266): a, c, t, g, unknown or other
  modified_base (568)..(568): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttgggctgaactgggttttcctcgtagtctcttttaagaggtgtccagtgtcagatgcagctggtggagtcgtgggggagtcgtggtccaggccgtgggggtccctggacgtctctctgtcgcncgcctgtgacttactaacttaactaaaattgtaggatcgacgtacggttcggccgccgacggcctaccgagggacggaacggggcgtggggtacgggtcgggtacgtaactaacgttatacctagtagttaggtagttaaggttaaacggtttaaaagtttaacgtacgttaacgtacggggtaaccgtaccgttacgggtaacggggaaccggtccgtacttacccgaacctacgtcctaaccgaaaggacaaactaacgtacgaaagtcaacctactacttacttagttacataaacganacgacgcggtaggcgtacgacgaacggacgcgttctacggtttactacgttacggttacgaccggtaaacggaaccgtacccggttaccgtaggtacggggtcggggttaaggtacggtttacgg

SEQ ID NO: 404460 - DNA, 722 bp, Homo sapiens
  misc_feature: GZ8MTXP02ILNSL.38.35.D02.1.454.CMB.2.raw
  modified_base (270)..(270): a, c, t, g, unknown or other
  modified_base (316)..(316): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgagactctcctgtcgcagcctntggattacaacttacaaaattgaggatgtacgtggtccgcgaggcnccgaggcgaaggggtcgtgggaggtggggtcggactaaacgtatagtaccaagttatgtaagttaaggtaaagtttttaaaacgacgttagtacggaccggtaccttaccgggtacgggaaacgggtacccgtacgtttacccaacccgttaacgtcccgtaacccgaaagtacgaaaaccttaaacttaccccgaaaaagggtaccgaaccctaaaccgttaacctttacctttaaagtttacgaaaccttaaaagttacggaaaacctcggtacccgtagggggactaccggtagaacggaaccgacggtcgttgtaacgttactttacgcgttacgaacgtaaaaccggtcccgtacccgttagtacgggttacgggggtaccgggtaacgtttagtccgggg

SEQ ID NO: 404461 - DNA, 629 bp, Homo sapiens
  misc_feature: GZ8MTXP02FRK9Y.38.35.D02.1.454.CMB.2.raw
  modified_base (264)..(264): a, c, t, g, unknown or other
  modified_base (270)..(270): a, c, t, g, unknown or other
  modified_base (272)..(272): a, c, t, g, unknown or other
  modified_base (309)..(309): a, c, t, g, unknown or other
  modified_base (550)..(550): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggatcgtggtccaggtccgtgggggtccctgacgctctcctgtgcngcctcngntacaacttacaaaattgtaggatgctacgtcggtccncgacggctccgaggcgaagggcgtgggaggtgggtcgacaaacgtatacgtactatatagtagtaaggtaaacgttttaagactagtcggaccggtactacggtagggaacggtcctacgttacccactactacctccggaatacgaaactaactacccgaaaagacaacctaactaccttacttaatttacgaacctaaatacgaaactcgcgtaggacgacgtagaacggacgacggtnttacgtactacgtacgtacgacgaaaccgtaaccgtacccggtaccgttacggtcgggtacgggtacggttacgttacg

SEQ ID NO: 404462 - DNA, 742 bp, Homo sapiens
  misc_feature: GZ8MTXP02FGXP6.38.35.D02.1.454.CMB.2.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttgggctgaactgggttttcctcgtagcttcttttaagaggtgtccagtgtcagatgcagctggtggagtcgtgggggagtcggtggtccaggccgtggggggtccctggagtactctcctgtgcagcctcgtggtattacaacttacaaaaaattgtgggatgacacgtcgggtccgccaggctccgaggcgaaggggcagggaggtggggtacggacaaacgttatacgtcaagtagtggtaagttagggttaaaagtttttaagaccttaagtcggaccggtaacctaccgggtaggaaacggggtcccgtaatttcccgaaccctaacttaccgtacccctaaggaaccgtaaacgtaaaaccgttacccgaaaacgtacggaaccctaaacctaaccgtttaccctttaattttacggaaaaccctaaaagttaccgaaaacctacggtaccccggttaggggacgtacgtagggaacggaccgtaccggtaccttacgtacgttaacgtttaccgtacggtacggtaaccggaaaaccggtaccccggtacccgtacggttacggtacgggggtacggggttacgtttaacggg

SEQ ID NO: 404463 - DNA, 677 bp, Homo sapiens
  misc_feature: GZ8MTXP02II8WL.38.35.D02.1.454.CMB.2.raw
  modified_base (542)..(542): a, c, t, g, unknown or other
  modified_base (547)..(547): a, c, t, g, unknown or other
  modified_base (559)..(559): a, c, t, g, unknown or other
  modified_base (582)..(582): a, c, t, g, unknown or other
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccagccgtgggggtccctgagactctcctgtcgcagtcctctaggacttacaaacttacaaaaattacgtgggatacgcgtacgtcggggtccgacgcggcctcccgaggaccgaaggggcgtgggaggtgggtacggacgtaaacgtatacgtactagtagtagtaagtagggttaaaacgttttaagacgttaagtcggtaccgtaccgtccggtagggaaaccggggtctaactccgaaccgactaccgtacccaacgacgaaacctaataacccgaagtacgactaacctactactttattgaactaaancgaanacgcgtaggganccgtagaaccggacgtaccggtntacgttactaaacgttcgtaacggtacgaaccggtaaaacggtaacccccggtcgttaccggtagggttacgggggtacgggtttaacgttaagg

SEQ ID NO: 404464 - DNA, 488 bp, Homo sapiens
  misc_feature: GZ8MTXP01BHRLH.39.86.H09.1.454.CMB.2.raw
  modified_base (267)..(267): a, c, t, g, unknown or other
  modified_base (479)..(488): a, c, t, g, unknown or other
tcagtcgcactagtcacgaccggtgctcgatttagtgctatagacttgggtttggtggtccccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttatgaggtcagtaatcggccctcaggggtttctaatcgcttctctggctccaagtcnggcaacacggcctccctgaccatctctgggctccaggctgaggacgaggctgatttatactgcagctcatttgcaaatcaagtgaggtcttatgtcttcgggaagtggaccaaggtcatcgtcctaggtcagcccaagaccaacccactcgtcactctcgttccccaccctcctcactagtgcgactgagcggcttggcaaggcgcagttgnnnnnnnnnn

SEQ ID NO: 404465 - DNA, 520 bp, Homo sapiens
  misc_feature: GZ8MTXP01CVFSW.39.86.H09.1.454.CMB.2.raw
  modified_base (258)..(258): a, c, t, g, unknown or other
  modified_base (300)..(300): a, c, t, g, unknown or other
  modified_base (353)..(353): a, c, t, g, unknown or other
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctccnggtaccagcaatatccaggcacacgccccaaatcatcattangagtcagtatcgcctgaggttccatcgcttctctggctccaagtctggcaacncggcctccctgacccatctcgtggctccgaggctgaggacgaggacgtagtagttattactgcgatctctattatactatacgtagtgtaagtcgttagtgttcgtacggtaaggttacggacgacggtaacgtacgtcgtcgtacgttacgtaacgaaccgaaccg

SEQ ID NO: 404466 - DNA, 491 bp, Homo sapiens
  misc_feature: GZ8MTXP01A39XF.39.86.H09.1.454.CMB.2.raw
  modified_base (478)..(478): a, c, t, g, unknown or other
  modified_base (483)..(491): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattatactgccagctcatttgacaatcagtgaggcttatgtcttcggaagtgggaccaaggtcatcgtcctaggtcacgcccaaggcccaacccactcggtcactctcgttcccgccctcctcactagtcgcgactgaagcgggctggcaaggcgcnttagnnnnnnnnn

SEQ ID NO: 404467 - DNA, 476 bp, Homo sapiens
  misc_feature: GZ8MTXP01BLP0A.39.86.H09.1.454.CMB.2.raw
  modified_base (215)..(215): a, c, t, g, unknown or other
  modified_base (409)..(409): a, c, t, g, unknown or other
  modified_base (440)..(440): a, c, t, g, unknown or other
  modified_base (469)..(476): a, c, t, g, unknown or other
tcagtcgcactagtcacgaccggtgctcgatttagtgctatagacttgggtttgatggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangagtcagtaatcggccctgaggggtttctaatcgctttctctggctccaagtctggcaacacggcctccctgaccatctctgggctccaggctgaggacgaggctgattatactgcagctcatttgcaatcagtgagtcttatgtcttcggagtggacaaggtcatcgtctaggtcacgcccaagcccaacccntcgtcactctcgttcccaccctctcactgtncactgcgcgggcttggacaggcgcgatgnnnnnnnn

SEQ ID NO: 404468 - DNA, 502 bp, Homo sapiens
  misc_feature: GZ8MTXP01BBBLX.39.86.H09.1.454.CMB.2.raw
  modified_base (495)..(495): a, c, t, g, unknown or other
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaatcagcagtgacgttgggggtatgactatgtctcctggtaccagcaatatccaggcacacgcccccaaactcatcatttatgaggtcagtaatcggcctcaggggtttctaatcgcttctctggctccaagtctggcaacacggccctccctgacccatctctgggctccaggctgaggacgaggctggattattactgcagcttcatttgctaatcaagtgaaggcttattgtcttcgggaagttgggaccaaggtcaagtcgtcttaggtcngaacccg

SEQ ID NO: 404469 - DNA, 533 bp, Homo sapiens
  misc_feature: GZ8MTXP01BI6RE.39.86.H09.1.454.CMB.2.raw
  modified_base (226)..(226): a, c, t, g, unknown or other
  modified_base (257)..(257): a, c, t, g, unknown or other
  modified_base (301)..(301): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttgggggtatgactatgtctcnggtaccagcaatatccaggcacacgcccccaaatcatcatttangagtcagtaatcggccctgagggtttcctaatcgcttctctcggctccaagtctggcaacacggcctccctgaccatctctgggctcagctgaggacgaggctgactttattactgacagctcatttgctaaatctagtgaaggtctttagtcgttcgttacgggaaggttcgggacccttaagggttccaagttccgtacccgtagggttccctaacggccccgaaaccgg

SEQ ID NO: 404470 - DNA, 492 bp, Homo sapiens
  misc_feature: GZ8MTXP01ALERJ.39.86.H09.1.454.CMB.2.raw
  modified_base (481)..(481): a, c, t, g, unknown or other
  modified_base (486)..(492): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggccctcagggggtttctaatcgcttctctggctccaagtctggcaacacggccctccctgaccatctctgggctccaggctgaggacgaggctgattatactgccagctcatttgacaatcagtgaggcttatgtcttcggaagttgggaccaagggtcagtcgtctaggtcacgcccaaggcccaacccactggtcactctcgttccccgcctcctcactgtcgcgactggaagcgggctggcaaggcgcnttagnnnnnnn

SEQ ID NO: 404471 - DNA, 503 bp, Homo sapiens
  misc_feature: GZ8MTXP01ALCJW.39.86.H09.1.454.CMB.2.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgcccccaaactcatcatttatgagtcagtatcgcctgagggtttcctatcgcttctctggctcaagtctggcacacggcctccctgaccatctcgtgggctccgaggctgaggacgagctgattatactgcagctcatttgctaatcaggtgaaggtcttagtgttccgttaggaagttcgggacaaggtcagtcgtcgtaggttcaacgcccgtaacgg

SEQ ID NO: 404472 - DNA, 528 bp, Homo sapiens
  misc_feature: GZ8MTXP01D1E1I.39.86.H09.1.454.CMB.2.raw
  modified_base (249)..(249): a, c, t, g, unknown or other
  modified_base (262)..(262): a, c, t, g, unknown or other
  modified_base (382)..(382): a, c, t, g, unknown or other
  modified_base (424)..(424): a, c, t, g, unknown or other
  modified_base (452)..(452): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttangactatgtctccnggtaccagcaatatccaggcacacgacccccaaatcatcatttatgagtcagtaatcgcctgtagggtttcctaatcgcttctctgctcaagtctggacaacacggctccctgaccatcnctggctccaggctgacggacgaggctgatttatatgcagtcnctatttgactaaatcgtaagtgaaggtnttaagtgttccgttagggaagttacggggaccttaagggtcagttcgtctagggttacaacgaacccgaaacccgg

SEQ ID NO: 404473 - DNA, 482 bp, Homo sapiens
  misc_feature: GZ8MTXP01BM2TK.39.86.H09.1.454.CMB.2.raw
  modified_base (475)..(482): a, c, t, g, unknown or other
tcagtcgcactagtcacgaccggtgctcgatttagtgctatagacttgggtttgatggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttatgaggtcagtaatcggccctcaggggtttctaatcgcttctctggctccaagtctggcaacacggcctccctgaccatctctgggctccaggctgaggacgaggctgattatactgcagctcatttgcaatcagtgaggcttatgtcttcggaagtgggaccaaggtcatcgtctaggtcagcccaaggccaaccccgatgtcacctctcgttccccaccctcctcactagtgcgactgagcgggcttggcaaggcgcatgnnnnnnnn

SEQ ID NO: 404474 - DNA, 512 bp, Homo sapiens
  misc_feature: GZ8MTXP01C4F1E.39.86.H09.1.454.CMB.2.raw
  modified_base (248)..(248): a, c, t, g, unknown or other
  modified_base (302)..(302): a, c, t, g, unknown or other
  modified_base (307)..(307): a, c, t, g, unknown or other
tcagtcgcactagtcacgaccggtgctcgatttagtgctatagacttgggtttgggggggtctcaggaggcagcgctctcaggacatctcctaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtangactatgtctctggtaccagcaatatccaggcacacgccccaaatcatcattangagtnagtatcggcctgagggtttccaatcgcttctctgctccaagtctggacaacgacggcctccctgaccatctctgggctccgaggctggacggacgaggctagtagttacttactgctagctcatttgctaatcagtgaagtcttatgttcgttaggagttcgggccaaggtcaatcgtactacgggttactaacgcccgaaccgg

SEQ ID NO: 404475 - DNA, 513 bp, Homo sapiens
  misc_feature: GZ8MTXP01BIBR1.39.86.H09.1.454.CMB.2.raw
  modified_base (260)..(260): a, c, t, g, unknown or other
  modified_base (430)..(430): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccnggtaccagcaatatccaggcacagcccccaaatcatcatttatgaggtcagtaatcggccctgaggggtttcctaatcgcttctctggctccaagtctggcaacacggcctccctgaccatctctgggctccgaggctgaggacgaggctgatttattacgtgcagctcntttgctaatcagtgaaggtcttagtcgttgtcggaagttcgggaccaagggtcagtcgtcctaggttccaacgcccgaaccgg

SEQ ID NO: 404476 - DNA, 513 bp, Homo sapiens
  misc_feature: GZ8MTXP01DA2X0.39.86.H09.1.454.CMB.2.raw
  modified_base (329)..(329): a, c, t, g, unknown or other
  modified_base (348)..(348): a, c, t, g, unknown or other
  modified_base (455)..(455): a, c, t, g, unknown or other
  modified_base (502)..(502): a, c, t, g, unknown or other
  modified_base (504)..(513): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtcccctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacaggctgattatacngcagctcatttgcaaatcngtgaggtctttatgtcgttacgggaaagtcgggaccgaaggtctatcgtctaggtcacgcccgaaaggcccaaacccactcgtccacttctcgttccccgccctccnctacgtacgtcgccgacgtcgaggcggcgttggacgaaggcgacagngnnnnnnnnnn

SEQ ID NO: 404477 - DNA, 512 bp, Homo sapiens
  misc_feature: GZ8MTXP01D9E9C.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcagcagcgccccgaaactcttaatttatgagttctttcgtcggtccctcgaggggtttctacgtcgtcttctccgctaccaagtctggcaacacgcctcctgaccatctctagctcagctgagcgagctgacttattagttgcagctcatatactagagtcaatggtatcctagttggccttggttacggcggagggccttaagtcgtaccgtcgtaggtcacgcccgaagggtccc

SEQ ID NO: 404478 - DNA, 540 bp, Homo sapiens
  misc_feature: GZ8MTXP01DSEMF.39.86.H09.1.454.CMB.2.raw
  modified_base (262)..(262): a, c, t, g, unknown or other
  modified_base (307)..(307): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccnggtaccagcaatatccaggcacacgcccccaaactcatcatttangagtcagtaatcggcctgtaggggtttcctaatcgcttctctggctcaagtctggacacacggcctccctgaccatctctagactccaggctgagacgaggctagactattatgcagctcattatactgtaagtacaagttgtattccacgttggtcgttggttccggggcggaacggggtaacctaaaggttcgaacccggttccgttagggttccgaaccggtaaccccgg

SEQ ID NO: 404479 - DNA, 643 bp, Homo sapiens
  misc_feature: GZ8MTXP01EJ7Y5.39.86.H09.1.454.CMB.2.raw
  modified_base (228)..(228): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctccgtggtaccagcaatatccaggcacacgacccccaaatcatcatttatgagtcagtaatccggcctcgtagggtttcctaagtcgtcttctctggcctcgaagtctacggaccaaccgcccggtcctcccgtacgaccctactcgtccgtcggggcccttaccggacggtccgtagggaacgggacggtacgggtacgttaggtaattttaacgttaactcggtactacggtccttctaagttttcggacctaaattcgtaaggtggtaaggttcgtttaagttcggttacgttacggggtaaacggttcgggttaacccgttaagggttaacctacgttccggttaccgtacgggttaccaaccggttaacccgaaacccgg

SEQ ID NO: 404480 - DNA, 503 bp, Homo sapiens
  misc_feature: GZ8MTXP01AJ4PK.39.86.H09.1.454.CMB.2.raw
  modified_base (260)..(260): a, c, t, g, unknown or other
  modified_base (303)..(303): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccnggtaccagcaatatccaggcacagcccccaaatcatcatttangaggtcagtaatcggcctgaggggtttccaatcgcttctctggctcaagtctggcaacgacgcctccctgaccatctctgggctccgaggctgaggacgaggctgattatactgacagctcatttcgctaatcagtgaagtcttagtgttcgttacgggaagttgggaccaaggtcagtcgtcaggttcaagcccgaacg

SEQ ID NO: 404481 - DNA, 485 bp, Homo sapiens
  misc_feature: GZ8MTXP01B78NB.39.86.H09.1.454.CMB.2.raw
  modified_base (236)..(236): a, c, t, g, unknown or other
  modified_base (337)..(337): a, c, t, g, unknown or other
  modified_base (469)..(469): a, c, t, g, unknown or other
  modified_base (472)..(472): a, c, t, g, unknown or other
  modified_base (477)..(485): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctnaggggtttctaatcgcttctctggctccaagtctggcaacacggcctccctgaccatctctgggctccaggctgaggacgaggctgattattactgccagntcatttgcaatcagtgaggcttatgtctaggagtggacaaggtcatcgtctaggtcagcccaagccaacccactcggtctactctcgttcccaccctcctcactagtgcgactgaacgcgggctggcaggcncgnttagnnnnnnnnn

SEQ ID NO: 404482 - DNA, 538 bp, Homo sapiens
  misc_feature: GZ8MTXP01EHW56.39.86.H09.1.454.CMB.2.raw
  modified_base (260)..(260): a, c, t, g, unknown or other
  modified_base (304)..(304): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcnggtaccagcaatatccaggcacacgcccccaaatcatcatttangagtcagtatccgcctgagggtttccaatcgcttctctgctcgaagtcctaggaccaacgaccggcctaccctgacctatctcgtcgggctcgaggtctggaggacgaggctgtattattacgtgcagtctactatttcgactaatcgtagtgaaggttcttagtgttcgtacggaaggttacggaccttagggtcagttccgtactaggttacaaccgttaaccgaaacccgg

SEQ ID NO: 404483 - DNA, 516 bp, Homo sapiens
  misc_feature: GZ8MTXP01DM1SJ.39.86.H09.1.454.CMB.2.raw
  modified_base (260)..(260): a, c, t, g, unknown or other
  modified_base (504)..(504): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcnggtaccagcaatatccaggcacacgcccccaaactcatcatttatgaggtcagtaatcggcctcgtaggggtttccaatcgcttctctggctccaaagtctggcaacacggcctccctgaccatctctgggctccgaggtctgaggacgaggctagattatactgcagctctatttgctaaatcgaagtgaaggtcttatgttcttacgggagttggggaccaagggtcatcgtcgtaggttcncgcccgaaccgg

SEQ ID NO: 404484 - DNA, 566 bp, Homo sapiens
  misc_feature: GZ8MTXP01BBSKP.39.86.H09.1.454.CMB.2.raw
  modified_base (218)..(218): a, c, t, g, unknown or other
  modified_base (555)..(555): a, c, t, g, unknown or other
  modified_base (557)..(557): a, c, t, g, unknown or other
  modified_base (559)..(562): a, c, t, g, unknown or other
  modified_base (564)..(564): a, c, t, g, unknown or other
  modified_base (566)..(566): a, c, t, g, unknown or other
tcagtcgcactagtcacgaccggtgctcgatttagtgctatagacttgggtttgatggtctcccagtctgccctgactcaggctgcctccgtgtctgggtctctaggacagtcgatcaccatctcctgcactggaaccagcagtgacggttggggttatgactatgtctcctggtaccagcaatatccaggcacacgcccccaaaatcatctatttangaggtcagtaatcggccctgtaggggtttctaatcgcttctctggctcaagtctggcaacacggccctcccctgacccatctcgtgggcctccgaggctggacgggacgaggcttgatttatacctgcagctactatttgacaatcagtgagtcttagtgtacgtaggaagtggacctaggtcattccgtactaggtccacgacccgaaacggcccaaaccccgatcgtacccaccttccttccgttaccccacccttcctaccacgttacggtcgaccggtctaagggacgggccggggtcgttacggggaaccgaacgggcgaccgttagaaggngngnnnngngn

SEQ ID NO: 404485 - DNA, 509 bp, Homo sapiens
  misc_feature: GZ8MTXP01BVIUQ.39.86.H09.1.454.CMB.2.raw
  modified_base (259)..(259): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccnggtaccagcaatatccaggcacacgcccccaaactcatcatttatgaggtcagtatcggcctgagggtttccaatcgcttctctggctcagtctgggcaacacggcctccctgaccatcctcgtgggcctccgaggtctggaggacgaggctgatttatactgcagctcatttgctaatcagtgaaggtcttatgttcgttcgggaagttcgggaccaagggtcatccgcctaggccaagccccgaacgg

SEQ ID NO: 404486 - DNA, 500 bp, Homo sapiens
  misc_feature: GZ8MTXP01ESOK8.39.86.H09.1.454.CMB.2.raw
  modified_base (258)..(258): a, c, t, g, unknown or other
  modified_base (322)..(322): a, c, t, g, unknown or other
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccnggtaccagcaatatccaggcacagcccccaaactcatcatttatgaggtcagtaatcggccctnaggggtttccaatcgcttctctgctccaaagtctggcaacacggcctccctgacccatctctgggctccaggctgaggacgaggctgatttattactgcagctcatttgctaatcagtgaagtcttatgttcttcggaagttgggaccaggtcatcgtctaggttcaacgcccaacgg

SEQ ID NO: 404487 - DNA, 616 bp, Homo sapiens
  misc_feature: GZ8MTXP01D3FNN.39.86.H09.1.454.CMB.2.raw
  modified_base (227)..(227): a, c, t, g, unknown or other
  modified_base (247)..(247): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaccngcagtgacggttgggggtangactatgtctctggtaccagcaatatccaggcacacgcccccaaatcatctatttatgaggtcagtaatcgcctagtagggtttaccaatcgtcttctctggctccgaagtcctgggaccaacgaccggcctccctgacctagtctcgtcgggcttacccgagggtctcgggaaggaccgtagggaccttaggtaacttttacgttaaccgtgggtactaacgtccttaccgtattttacgacctaaattccgaggttggaaggttcgtttaagttcggttacgttacggggtaaaggttcggggaacccttaagggtcctaagttcccggttaccgtagggttacctaaccgaacccggaaaccccgg

SEQ ID NO: 404488 - DNA, 514 bp, Homo sapiens
  misc_feature: GZ8MTXP01CU91X.39.86.H09.1.454.CMB.2.raw
  modified_base (259)..(259): a, c, t, g, unknown or other
  modified_base (303)..(303): a, c, t, g, unknown or other
  modified_base (338)..(338): a, c, t, g, unknown or other
  modified_base (457)..(457): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacggttgggggttatgactatgtctcnggtaccagcaatatccaggcacacgcccccaaatcatcatttangaggtcagtaatcggcctgagggtttcctaatcgnttctctagctccaagtctagggccaacgacggccctcccgtgaaccatcctcgtcgggcctacgacgggctaggagaccgaggctagattattactgcagctcatttgctaatcagtgnggtcttatgttcgtcggaagttgggacaggtcatcgtctaggttcaacgcccgaacg

SEQ ID NO: 404489 - DNA, 521 bp, Homo sapiens
  misc_feature: GZ8MTXP01CJGFR.39.86.H09.1.454.CMB.2.raw
  modified_base (259)..(259): a, c, t, g, unknown or other
  modified_base (303)..(303): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcnggtaccagcaatatccaggcacacgcccccaaatcatcatttangaggtcagtactcgccctgagggtttccaatcgtcttctctggcctccgaagtcctgggcaacgaccggccctccctgacccatctcgtcgggctccgaggctgaggacgaggctagatttatactgcagtctctatttgactaatcagtgaagtcttagtgttcgttacggaagttcgggaccagggtcagtccgtctaggttcaacgcccgaaccg

SEQ ID NO: 404490 - DNA, 566 bp, Homo sapiens
  misc_feature: GZ8MTXP01C9RDN.39.86.H09.1.454.CMB.2.raw
  modified_base (259)..(259): a, c, t, g, unknown or other
  modified_base (304)..(304): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacggttgggggtatgactatgtctcnggtacagcaatatccaggcacacgacccccaaactcatcatttangagtcagtaactcgccctgtaggggtttccctaatcgtctttctcgtcggctccaagtctggacaaccacgggtccctccctgaccactcgtcgtcgggcctaccgacggtcgtaggacggacggaggacttggtaactttatttactagcgaagtcctactattttcgactaatcgaagttcgaagggtcttaagtcgttccgttaggaaggttcggaccgttaaggtcagttcgtctagggttccaacgcccgaaaccgg

SEQ ID NO: 404491 - DNA, 526 bp, Homo sapiens
  misc_feature: GZ8MTXP01CLMW9.39.86.H09.1.454.CMB.2.raw
  modified_base (216)..(216): a, c, t, g, unknown or other
  modified_base (513)..(513): a, c, t, g, unknown or other
  modified_base (518)..(526): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangaggtcagtaatcggccctcaggggtttctaatcgcttctctggctcaagtctggcaacacggcctccctgaccatctctggctccaggctggaggacgaggctgattattactgccagctctatttgactaatcagtgaggtcttagtgtcgttacgggaagttcgggaccaagggtcattcgtcgtaggtcaacgcccaaaggcccaaaccccacttcggtcctaacctccttccgttccccacccctcctacacctgtcgctacgtgaacggcgggctgggcgaaaggcgacgnttagnnnnnnnnn

SEQ ID NO: 404492 - DNA, 612 bp, Homo sapiens
  misc_feature: GZ8MTXP01CM0YJ.39.86.H09.1.454.CMB.2.raw
  modified_base (261)..(261): a, c, t, g, unknown or other
  modified_base (307)..(307): a, c, t, g, unknown or other
  modified_base (317)..(317): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttggggttatgactatgtctcnggtaccagcaatatccaggcacacgacccccaaactcatcatttangagtcagtancgcctcgagggtttccaatcgtcttctcgtcgctcccaagtctaggaccaaccgaccggccctaccctacgacctactctcgtcgggctccgaggctggacggacgaggctagtattacttactgacagtctactatttcgactaagtacgtaggttcgaacgggttactttagttcgttaccgtttaaacggggaacggtttacgggggaacccgttaaacgggttaacctaacggtttccgggttaacccgttacggggttaccgaacccggttaaccccgtaaaaccccggg

SEQ ID NO: 404493 - DNA, 533 bp, Homo sapiens
  misc_feature: GZ8MTXP01A39AR.39.86.H09.1.454.CMB.2.raw
  modified_base (503)..(503): a, c, t, g, unknown or other
  modified_base (525)..(533): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggccctgtaggggtttctaatcgcttctctggctccaagtctggcaacacggccctccctgacccatcctcgtggctccgaggctggaggacgaggctgattatactgccagctcatttgactaatcagtgaggtcttatgtcgtaggagtggacaggtcagtcgtacctaggtcacgacccaacggcccaaccccgactcgggtactaccttcctccgttaccccgcccctccctcgtacctacgtcgcgtacgtggaacggcgggttaccgnggcgaaacgggcgcgagttagnnnnnnnnn

SEQ ID NO: 404494 - DNA, 496 bp, Homo sapiens
  misc_feature: GZ8MTXP01CXA7A.39.86.H09.1.454.CMB.2.raw
  modified_base (488)..(496): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagccccaaactcatcatttatgagtcagtaatcggcctcaggggtttctaatcgcttctctggctccaagctggcaacacggcctccctgaccatctctggctccaggctgaggacgaggctgattatactgccagctcatttgacaaatcagtgagggtcttatgtctacggagtggacaggtcatcgtctaggtcacgcccaaacgccaaaccccgactcggtccacttcctcgttccgcccctcctcactacgtcgcgactggaagtcgggctcggcgaaggcgcattagnnnnnnnnn

SEQ ID NO: 404495 - DNA, 541 bp, Homo sapiens
  misc_feature: GZ8MTXP01B363V.39.86.H09.1.454.CMB.2.raw
  modified_base (227)..(227): a, c, t, g, unknown or other
  modified_base (305)..(305): a, c, t, g, unknown or other
  modified_base (381)..(381): a, c, t, g, unknown or other
  modified_base (440)..(440): a, c, t, g, unknown or other
  modified_base (468)..(468): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcatcctcctcactcagggcacagggtcctgggcccagtctgccctgactcaggctgcctccgtgtctgggtctctaggacagtcgatcaccatctcctgcactggaaccngcagtgacggttggggtatgactatgtctcctggtaccagcaatatccaggcacacgacccccaaatcatctatttangagtcagtactcggcctcgtacggggtttctagtcgtcttctctcggctccaagtctggacaacgcggccctcccngacctatcctcgtgggacctccgaggcctaggacgacgaggctagggtatttagttacngcagtctcgtatttgactaatcgagtgnggttcttagttgttcgttcgggaaggttcgggaacctaagggtcaagttcgtccttaggtccaacgaaccccg

SEQ ID NO: 404496 - DNA, 529 bp, Homo sapiens
  misc_feature: GZ8MTXP01EO7NT.39.86.H09.1.454.CMB.2.raw
  modified_base (247)..(247): a, c, t, g, unknown or other
  modified_base (259)..(259): a, c, t, g, unknown or other
  modified_base (271)..(271): a, c, t, g, unknown or other
  modified_base (300)..(300): a, c, t, g, unknown or other
  modified_base (310)..(310): a, c, t, g, unknown or other
  modified_base (351)..(351): a, c, t, g, unknown or other
  modified_base (360)..(360): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtangactatgtctcngtaccagcaatnccagcacacgacccccaatcatcatttangagtcagtancgcctgtaggttccatcgcttctctgctcagtctagcaacncgcctcccngacatctcgtcgggctaccgaggtctaggacggacgaggcttagtaagtttatacgtgaccagtcctagtatttacgactaatcgaagttggaagttcttagtcgttacgttaacgggagttacggttaccaagggtctacgtcgtactagggccaacgcccgaaaccg

SEQ ID NO: 404497 - DNA, 528 bp, Homo sapiens
  misc_feature: GZ8MTXP01EQ58P.39.86.H09.1.454.CMB.2.raw
  modified_base (228)..(228): a, c, t, g, unknown or other
  modified_base (380)..(380): a, c, t, g, unknown or other
  modified_base (438)..(438): a, c, t, g, unknown or other
  modified_base (508)..(508): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctcctggtaccagcaatactccaggcacacgacccccaaatcatcatttatgagtcagtaatcggcctcgtaggggtttcctaatctcttctctgctcaagtctggcaaccgacggcctcccngacctatctctgggctccgagctggaggacgagtctagtattattacgtgcagtcctntatttcgactaatctagtgtaaggtcttagtcgttcgtaggtaaggttacggacgttagtcagtcgtacnggttactaaccgcgaacccg

SEQ ID NO: 404498 - DNA, 633 bp, Homo sapiens
  misc_feature: GZ8MTXP01ACGTF.39.86.H09.1.454.CMB.2.raw
  modified_base (264)..(264): a, c, t, g, unknown or other
  modified_base (281)..(281): a, c, t, g, unknown or other
  modified_base (296)..(296): a, c, t, g, unknown or other
  modified_base (330)..(330): a, c, t, g, unknown or other
  modified_base (369)..(369): a, c, t, g, unknown or other
tcagtcgcactagtcacgaccggtgctcgatttagtgctatagacttggggtttggggggggtctcaggaggcagcgctctcaggacatctccaccatggcctgggctctgctgctcctcaccctcctcactcagggcacgagggtcctgggcccagtctgccctgactcaggctgcctcgtgtctgggtctcgtaggacagtcgatccaccatcctcctgccacgtacggaaccagcgtaggtggtacgggttgggggttacnggacttatcgtctccgnggtaccagacaatcnccaggcacaccgacccccaatcatctaatttagngagtcagtactcggccctagtaggtttaccatcgcttcncgtagcctcagtcctaggaccacgcgcctcccgtgacctatcgtcggtcggtcctccggagccgtaggacggacggtggacctttaggaactttatacgtgacgtaccgtcttacttagtttacacgtaacttcgaaggttgaacgttctttaacggtcggttacggttaacgggtaacgggttcgggttaaacccgaagggtttcccaaacggttcccgttaccggtacgggttacctaacccggaaccccggtaaaccccgg

SEQ ID NO: 404499 - DNA, 572 bp, Homo sapiens
  misc_feature: GZ8MTXP01C237P.39.86.H09.1.454.CMB.2.raw
  modified_base (308)..(308): a, c, t, g, unknown or other
  modified_base (348)..(348): a, c, t, g, unknown or other
  modified_base (399)..(399): a, c, t, g, unknown or other
  modified_base (474)..(474): a, c, t, g, unknown or other
tcagtcgcactagtcacgaccggtgctcgatttagtgctatagacttggggtttggggggggtctcaggaggcagcgctctcaggacatctccaccatggcctgggctctgctgctcctcaccctcctcactcaggcacagggtcctgggcccagtctgccctgactcaggctgcctccgtgtctggtctctaggacagtcgatcaccatctcctgcactggaaccagcagtgtacggttgggggttatgactatgtctcctggtaccagcaaatatccaggcacacgcccccaaatcatctatttangaggttcagtaatccggcctgaggggtttcccaagtcgtnttctctacggctccaagtcgtggaccaacgaccggccctccctagaccctntcctcgtcgggcctcgacggcgtggacggacgaggccttctcgttaattattgcagtctacatatacagctattnctacgttgggttagttccgggacgggtaacgggttacccgttccgttcggtaacccgtacgttaagggtcacggaccccgtaaggcccgttaacccgg

SEQ ID NO: 404500 - DNA, 502 bp, Homo sapiens
  misc_feature: GZ8MTXP01D3QPE.39.86.H09.1.454.CMB.2.raw
  modified_base (359)..(359): a, c, t, g, unknown or other
  modified_base (437)..(437): a, c, t, g, unknown or other
  modified_base (456)..(456): a, c, t, g, unknown or other
  modified_base (489)..(489): a, c, t, g, unknown or other
  modified_base (494)..(502): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttatgaggtcagtaatcggccctctaggggtttctaatcgcttctctggctccaagtctggcaacacggcctccctgaccatctctggctccaggctgaggacgaggctgattatactgccagctcatttgacaatcagtgagcttangtcttacggagtggacaaggtcatcgtctaggtcacgcccaacggcccaacccactcggtacacttcctccgttcccncccttcctctactacgtcncgactggaacgcgggctcgggacgaaggcgacnttagnnnnnnnnn

SEQ ID NO: 404501 - DNA, 644 bp, Homo sapiens
  misc_feature: GZ8MTXP01B53LX.39.86.H09.1.454.CMB.2.raw
  modified_base (228)..(228): a, c, t, g, unknown or other
  modified_base (308)..(308): a, c, t, g, unknown or other
  modified_base (318)..(318): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctccgtggtaccagctaatatccaggcacacgcccccaaatcatcatttangagtcagtanccgcctagtaggggtttcctaagtcgtcttctcgtcgggctccgaaagtccgtcgggaccaacgacccgggccctaccctagaccctactcctccgtacggggccttacccgagggtcctaggaacgggaccgaggtactaggttaatttacgtttaacgttgaccctaaggtccttactaagttttcgaacctaaagtccgtaaggtggtaaggtactttagtcggttacgttaccgggaaggttaccggggaaccttaacgggttaacctacgttccgggttaccgttacgggttacccgaaccggttccccgtaaaacccggg

SEQ ID NO: 404502 - DNA, 593 bp, Homo sapiens
  misc_feature: GZ8MTXP01A7BEC.39.86.H09.1.454.CMB.2.raw
  modified_base (229)..(229): a, c, t, g, unknown or other
  modified_base (263)..(263): a, c, t, g, unknown or other
  modified_base (275)..(275): a, c, t, g, unknown or other
  modified_base (306)..(306): a, c, t, g, unknown or other
  modified_base (311)..(311): a, c, t, g, unknown or other
  modified_base (317)..(317): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccngcagtgtacggttgggggttatgactatgtctcngtaccagcaatntcaggcacacgacccccaaatcatctattangagtnagtacnccggtcctgtacgggtttcacggtcgtcttccgtccggtcctaccgaagtcgtacgggaccaccgaccggtccctcccgtagaccctagttcctacgtacgacctcgaggccgtaggacgggacgacggtctagtacttagttacgtgaccagtctactattaactacgtagtaaagtctaagttcggtaactccgaggttcggcgttacgggtcgggacgggttacggaccgttaaggtcgtaacccggtcgtacgttcaaccggcccgtaacgg

SEQ ID NO: 404503 - DNA, 539 bp, Homo sapiens
  misc_feature: GZ8MTXP01BHTJQ.39.86.H09.1.454.CMB.2.raw
  modified_base (228)..(228): a, c, t, g, unknown or other
  modified_base (249)..(249): a, c, t, g, unknown or other
  modified_base (262)..(262): a, c, t, g, unknown or other
  modified_base (308)..(308): a, c, t, g, unknown or other
  modified_base (369)..(369): a, c, t, g, unknown or other
  modified_base (438)..(438): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttangactatgtctccnggtaccagcaatatccaggcaacacgacccccaaatcatcatttangagtcagtatccggcctgtaggggtttcctaatcgcttctctggctccaagtctggcaacncggcctccctgaccatctcgtgggctcccgaggctggaggacgagggctgatttattacgtgcagtctntatttgctaatcgaggtgaaggtctttagtcgttcgtacggtaaggttcgggaccttaaggtctagtccgtccgtaggttacctaacggcccgaaacccgg

SEQ ID NO: 404504 - DNA, 533 bp, Homo sapiens
  misc_feature: GZ8MTXP01A2GO2.39.86.H09.1.454.CMB.2.raw
  modified_base (229)..(229): a, c, t, g, unknown or other
  modified_base (261)..(261): a, c, t, g, unknown or other
  modified_base (305)..(305): a, c, t, g, unknown or other
  modified_base (315)..(315): a, c, t, g, unknown or other
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggtatgactatgtctcnggtaccagcaatatccaggcacacgcccccaaatcatcatttangagtcagtancgcctgtaggggtttcctaatcgtcttctctggcctcaagtctggcaacacggcctccctgaccatcctcgtgggcctccgaggcctggacgggacgaggctaggagttatacgtgcagctcgtatttgactaatcagtgtaaggctttagtcgttcgttacgggaaggttcgggaccttaggtcagtcggtacctaggcctaacgcccgaaacccgg

SEQ ID NO: 404505 - DNA, 641 bp, Homo sapiens
  misc_feature: GZ8MTXP01EM4BN.39.86.H09.1.454.CMB.2.raw
  modified_base (226)..(226): a, c, t, g, unknown or other
  modified_base (240)..(240): a, c, t, g, unknown or other
  modified_base (264)..(264): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcacatctcctgcactgaaccngcagtgacgttggngtcttatatatgtctctgttcaangcatcagcagccgacccgtaaacttctttaaatttagtgtacgtttctttccggtcggtccctgtaggggtttctacgtccgtcttcgtccggctaccaagtcgtcggaccaacgaccggtccctccctacgaccctacgttctactacgaccttaccgagggtcctaggacggacgacgggtctaggtaacttatttacgtgtactagtctactaatactacgtagtaacgtactaaagttcggtaactccgtaacgttcgggtacgtttcgggttaccggggtacgggttaacgggttaaccttaacgggtttcccggtaacccggtttaaccggtacgggtcccgaaccggtccccgttaaacgggttcccccg

SEQ ID NO: 404506 - DNA, 509 bp, Homo sapiens
  misc_feature: GZ8MTXP01EM47Z.39.86.H09.1.454.CMB.2.raw
  modified_base (305)..(305): a, c, t, g, unknown or other
  modified_base (431)..(431): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctctggtaccagcaatatccaggcacacgcccccaaatcatcatttangagtcagtatcgcctgagggtttccaatcgtcttctctggctcgaagtctaggcaacacggcctccctgaccctatctcgtgggcctcgaggctaggaggacgaggctgattattactgcagcctntatttcgactatctagtgaagtcttatgttcgtaggaagttcgggacaggtcagtcgtctaggttcaacgcccgaacg

SEQ ID NO: 404507 - DNA, 534 bp, Homo sapiens
  misc_feature: GZ8MTXP01B1W1F.39.86.H09.1.454.CMB.2.raw
  modified_base (229)..(229): a, c, t, g, unknown or other
  modified_base (263)..(263): a, c, t, g, unknown or other
  modified_base (309)..(309): a, c, t, g, unknown or other
  modified_base (377)..(377): a, c, t, g, unknown or other
  modified_base (407)..(407): a, c, t, g, unknown or other
  modified_base (436)..(436): a, c, t, g, unknown or other
  modified_base (455)..(455): a, c, t, g, unknown or other
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctccnggtaccagcaatactccaggcacacgcccccaaactcatcatttangagtcagtatcggcctgaggggtttccaatcgtcttctctgctcaagtctggacacgacggcctcccngaccatctctgggctccgagctgaggacgngctgattattactgcagtctctatttcgntaatcaagttgaacggttntttagtcggttcgttacgggaagttcgggacccttaagggtctagtccgtcccgtaggttactaacgcccgtaacccgg

SEQ ID NO: 404508 - DNA, 692 bp, Homo sapiens
  misc_feature: GZ8MTXP01BR8XL.39.86.H09.1.454.CMB.2.raw
  modified_base (228)..(228): a, c, t, g, unknown or other
  modified_base (261)..(261): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctcnggtaccagcaatatccaggcacacgacccccaaatcatctatttatgagtcagtactccgcctgtaggggtttcctaagtcgtcttctcgtacgggccctccgaaagtccgtagggaccaaaccgtacccgggtcccttccccgtacgaccctactctccgtcgggcctaccgaggtctagggaacgggacggaggtccgttaggtaacttttaacgttacgtaggtacctaacggtccttacgttaacttttacggaacctaaagttaccgtaggttaggtaacgggttcctttaaggttccggtttaccgggttaaaccggggtaacggggtttaccggggttaaaccgttaaacgggttcctaacggtttcccggttacccggttacgggttacccgtaacccgggttaaccccgtaaaacccccggg

SEQ ID NO: 404509 - DNA, 514 bp, Homo sapiens
  misc_feature: GZ8MTXP01ELST5.39.86.H09.1.454.CMB.2.raw
  modified_base (251)..(251): a, c, t, g, unknown or other
  modified_base (263)..(263): a, c, t, g, unknown or other
  modified_base (270)..(270): a, c, t, g, unknown or other
  modified_base (406)..(406): a, c, t, g, unknown or other
  modified_base (431)..(431): a, c, t, g, unknown or other
  modified_base (438)..(438): a, c, t, g, unknown or other
  modified_base (455)..(455): a, c, t, g, unknown or other
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacagggtcctgggcccagtctcgccctgactcaggctgcctccgtgtctgggtctctaggacagtcgatcaccatctcctgcactggaacagcagtgacggttgggggttangactatgtctcngtacagnaaatatcaggcacacgacccccaaactcactcaatttatgagtacaagtaatcggcctcgtaggggtttcctaatcgctctctgctccagtctgacacacgctccctgacatctctgggctccaggctggagacgnggctgtattaagtctgcaagtcctntatttgntaaatcgagtgaagttnttagtgttcgtaggtaaggttcggacttagtctagtccgtcgagacaacgaaccgaacg

SEQ ID NO: 404510 - DNA, 700 bp, Homo sapiens
  misc_feature: GZ8MTXP01DS9ZD.39.86.H09.1.454.CMB.2.raw
  modified_base (228)..(228): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggtatgactatgtctccgtggtaccagacaatactccaggcacacgacccccaaatcatctatttatgaggtactagtaatccggcctcgtacggggttttccaagtcgtacttcgtctacggcctccgaagtcctagggacccaaaccgacccgggtccctccctcgtaccctatccgtcgtacgggtccctaccggacggtccgtaggaacgggaacggacgggtaccttaaggttaacttttaaacgttttacgcggtaacctaggtccttacttaagttttacgaacctaaacttacggtaaggttcgggtaaaccgttagttttaaacggtttccgggtttaacggttaaaccggggtaacgggttaacggggttaaccgttaaacgggttaacgtacgttaacccggttacgtacgggttaccgaaccgttaaccccggtaaaaccccggg

SEQ ID NO: 404511 - DNA, 586 bp, Homo sapiens
  misc_feature: GZ8MTXP01B4WZF.39.86.H09.1.454.CMB.2.raw
  modified_base (228)..(228): a, c, t, g, unknown or other
  modified_base (368)..(368): a, c, t, g, unknown or other
  modified_base (378)..(378): a, c, t, g, unknown or other
  modified_base (385)..(385): a, c, t, g, unknown or other
  modified_base (408)..(408): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctcctggtaccagcaatatccaggcacacgcccccaaactcatctatttatgaggtcagtatcggcctcgtaggggtttcctatcgtcttctctgctccagtctggacacncggcctcccngacatcncgtggctccgagcgtggagacgngctgtattattactgcagtctctatttcgactaatcgtaaggtcggtaaggttctttaagttcggttacgtttaacgggggtaaaggttaccgggggttaaaccgttaacgggttcccgtacgttcccggttccggtaacgggttacccgtaacccggaaccccgtaaaaccccgggg

SEQ ID NO: 404512 - DNA, 498 bp, Homo sapiens
  misc_feature: GZ8MTXP01CP4JS.39.86.H09.1.454.CMB.2.raw
  modified_base (215)..(215): a, c, t, g, unknown or other
  modified_base (235)..(235): a, c, t, g, unknown or other
  modified_base (487)..(487): a, c, t, g, unknown or other
  modified_base (491)..(498): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctactggtaccagcaatatccaggcacagcccccaaactcatcatttangaggtcagtaatcggccctnaggggtttctaatcgcttctctggctccaagtctggcaacacggcctccctgaccatctctggctccaggctgaggacgaggctgattatactgccagctcatttgacaatcagtgaaggtcttagtgttcttcgggaagttgggaaccaagggtcatcgtctaggtcacgcccaagcccaacccatcggtcactctcgtccccaccctcctcactgtgccgtactgaacgcgggctggcgaaacggcgacnacgnnnnnnnn

SEQ ID NO: 404513 - DNA, 519 bp, Homo sapiens
  misc_feature: GZ8MTXP01B25CI.39.86.H09.1.454.CMB.2.raw
  modified_base (248)..(248): a, c, t, g, unknown or other
  modified_base (260)..(260): a, c, t, g, unknown or other
  modified_base (305)..(305): a, c, t, g, unknown or other
  modified_base (315)..(315): a, c, t, g, unknown or other
  modified_base (366)..(366): a, c, t, g, unknown or other
  modified_base (376)..(376): a, c, t, g, unknown or other
  modified_base (385)..(385): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttangactatgtctcnggtaccagcaatatccaggcacacgcccccaaactcatcatttangagtcagtancggcctacgaggggtttccaatcgcttctctggctccaagtctggccaacncggcctcccngaccatctntaggcctcgaggtctaggaggacgaggctagtatttagttacctgactagctcatttcgctaatcgaggtgaaggtcttagtcgttgttacgggagttcgggacagggtcagtcgtcagccaacgcccgaaccg

SEQ ID NO: 404514 - DNA, 535 bp, Homo sapiens
  misc_feature: GZ8MTXP01CR2NF.39.86.H09.1.454.CMB.2.raw
  modified_base (312)..(312): a, c, t, g, unknown or other
  modified_base (343)..(343): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctcctggtaccagcaatatccagcacacgacccccaaatcatctatttatgaggtnagtatcgcctgtagggtttcaatcgtcttcnctaggctccagtctagggcaacgcggcctccctagacccatccgtcgtcgggcctacgaggctcggagggtacgaggctagtattattacgtgcagtcctctatttgactaatcgaggtgaaggtcttagtcgttcgttacggagttcgggacttaggtcacgtcgtccgtaggttccaacggcccgaaccg

SEQ ID NO: 404515 - DNA, 530 bp, Homo sapiens
  misc_feature: GZ8MTXP01DIRUU.39.86.H09.1.454.CMB.2.raw
  modified_base (309)..(309): a, c, t, g, unknown or other
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagacaatatccaggcacacgcccccaaactcatcatttangagtcagtatcgcctgtagggtttccatcgtcttctctcgctcaagtctaggacaacgacggcctcccacgacctatcctcgtcgggcctacgacggctagggaggacgaggctagtaatttattacgtgactagtctctatttgactaatcgagtgaagtcttagtgttcgtacggtagttacggcttaaggtctatcgtctaggttcaacgccgaaccg

SEQ ID NO: 404516 - DNA, 551 bp, Homo sapiens
  misc_feature: GZ8MTXP01BYRCF.39.86.H09.1.454.CMB.2.raw
  modified_base (217)..(217): a, c, t, g, unknown or other
  modified_base (412)..(412): a, c, t, g, unknown or other
  modified_base (542)..(551): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacacgccccccaaatcatcatttangagtcaagtatccggccctcgtaggggtttctaatccgcttctctggctccaagtctggcaaccgacggccctccctgacccatctcgtcgggctccgaggctggaggacgaggtcctgtaattattactgcagtctcatttgaactaatcgagtcgaggtcttagtcgttcgtacggaagtcggaactaggtcngtccgtacctagggtccacgacccgacggaccctaaccccagttcggtccctacttccctacccgttccccaccctctacgtcgtcgtccgtacgtggacgggccggtgttcgggacacggcgcagttgnnnnnnnnnn

SEQ ID NO: 404517 - DNA, 762 bp, Homo sapiens
  misc_feature: GZ8MTXP01B7I2W.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccaggtctggccctgactcaggctgcctccgtgtctgggtctctaggacagtcgatcaccatctcctgcactggaaccagcagtgacggttggggttatgactatgtctccgtggtaccagcaatatccaggccaccaccgacccccaaaactcacttactaatttacgtggtacgggtacctaaaggttaaccgtcccggtacccgttacggttacgggggttttacccctaacgttcggttccgtttctcccgttacgggtacccttcccggtaaagttcccgtacgggacccaaacccggtacccgggtcccccttacccgtccgtaaccctacgttccgttccggtcggggtcccttacccggaacgggtccgttaaggggaacgggtaaccgggtagggttaccgttagtttaaacgtttaacgttacggtcgtaccgtacgttaccttgttacgtttacgacgttaacgtcgtaaggttacggttaacggttacgtttacggttcgggtttacggtaaacggggttaacggttacgggttaaccgttaacggtcccgttacggttccggttccggtacggttaccaacccgggaacccgtaaccg

SEQ ID NO: 404518 - DNA, 698 bp, Homo sapiens
  misc_feature: GZ8MTXP01DBTBR.39.86.H09.1.454.CMB.2.raw
  modified_base (311)..(311): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccagcagtgtacggttgggggttatgactatgtctcctggtaccagcaatatccaggcacaccgacccccaaactcatctattangagtcagtatccggtcctgtacgggtttctaagtcgtcttctcgtcggctcgaagtccgtacgggaccaaaccgaccggtcccctaccccgtacgtaaccctacgttccgtcgtcggggtacccttaccgaacggggtccgttagggaacgggaaccggtacgggtaccgtttacgggttaaatttttaacgtttaaccgttcggtaccgtaacgtcccttacttagttttacgactaaacgttccgtaaggttcggtaacggttcgtttacgtttcggttaaccggttttacgggggaacgggtttacgggggaccggttaacgggttcctaacgttccggttacccgtagggttacccgaaccggttaaccccgtaaaccccggg

SEQ ID NO: 404519 - DNA, 675 bp, Homo sapiens
  misc_feature: GZ8MTXP01ELLNO.39.86.H09.1.454.CMB.2.raw
  modified_base (262)..(262): a, c, t, g, unknown or other
  modified_base (307)..(307): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggtatgactatgtctcgngtaccagacaatatccaggcacacgcccccaaactcatctattangagtcagtaatccggcctagtaggggtttacctaagtcgtcttctcgtgcctccgaagtcctacggacctaacgacccgggcccttaccctcgaaccctagtcccgtcgtcggggtcccttaccgaggtcgtaggaacgggacgaaggtcttaggtaatttacgttacgtcgtacgtatccctacgtaattttgacctaaagtaccgtaaggttggtaaaccggtttcgtttaacggttcggtttaaccgggttaaccggggtaaacgggttaccggggttaaaccggttaaacggttaaccgtaacggtttaacccggttaacccggttaacggttacccgtaacccggttaacccccgtaaacccg

SEQ ID NO: 404520 - DNA, 668 bp, Homo sapiens
  misc_feature: GZ8MTXP01A8XL6.39.86.H09.1.454.CMB.2.raw
  modified_base (228)..(228): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctctggtacagcaatatccaggccacacgacccccaaatcatctatttatggagtcgagtactccgcctagtacggggtttacctaatcgtctttctcgttacgggcccttaaccgaaaggttccgtacgggacccaaacccgtaccccgggtccccttaccccgtacgaaaccctcgttccgtccggtcggggtacccttcccggaacggtccgtacgggaacgggaccgtaggggtacttacggttaactttacgttaacgttcgacgtacgtccttacgtaagtttcgaactaatcgtaggttagaacggttctttagttcggttcggttacgggaaggttacgggttaccgaaacggttcgtcgttccggttaccgtagggttaccaaccggttaacccgaaacccg

SEQ ID NO: 404521 - DNA, 576 bp, Homo sapiens
  misc_feature: GZ8MTXP01B2EUV.39.86.H09.1.454.CMB.2.raw
  modified_base (228)..(228): a, c, t, g, unknown or other
  modified_base (306)..(306): a, c, t, g, unknown or other
  modified_base (434)..(434): a, c, t, g, unknown or other
  modified_base (494)..(494): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggtatgactatgtctctggtacagacaatactccaggcacacgacccccaaatcatctatttangagtcaagtaactccggtcctacgtaggggtttacctaactcgtacttcgtcgtcggtacctcgaagtcgtcggacaccgaccggccctaccctgaccactctcgtcggctaccgaggctggagacgngtactagtacgtttagtactcgacacgtctctagtttcgactatcgtagtgtaacggttnttagtcgttacggtagggtaacggttacggttacgttacggtctacgttccgtacgtacggttaccgaaccgaacccgaacg

SEQ ID NO: 404522 - DNA, 750 bp, Homo sapiens
  misc_feature: GZ8MTXP01BCIIM.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtggtacggttgggggttatggtactatcgtctccgtggtaccagacaatactccgacggcaacaaccgaccccctaaactcaacttctaacgttttagtacggtaacggtactaacgttaacgtcccgggtacccgttacggtaacgggggttttaccctaaacggttccgtaccgttttccgttccgtacgggtacccttaaccgtaaacggttcccggttaccgggtaccctaaaccggtaacccggggtcccctttaccccgtacgtaccgtaacttccgttaccggtcggggtccctaccggaagggtccgtagggaacgggtacggtacgggtacgttacggttaactttaacgtttaacgtcgtaaccgtaggtccttaccgtagtttacgacgtaacgtcgtaaggtgtaacggttcttagttcgttacggttaaagggtacggttacgggttaacgttacggttaaccagttccgtacgtacggttaccaaccgttaacccgtaaaccccg

SEQ ID NO: 404523 - DNA, 597 bp, Homo sapiens
  misc_feature: GZ8MTXP01DHCPS.39.86.H09.1.454.CMB.2.raw
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcgtggtaccagcaatatccaggcacacgacccccaaatcatctattatgagtcaagtactccggtcctgtacggggtttaccatcgtcttctcgtacgcttccgaaagtcgacggtaccaaaccgccggtccctacccctacgacctacttccgtcgtcgggcctccgacggtctaggacggacgaggtacttaggtatttaacgttacgtacgcctaagtccttcgttagtttacgactaaattcgagtgtaaggtcttagttgttcgttacgggtagttacgggacttaacggtctacgtccggtcgtacggttacctaacggaaccccgaaccg

SEQ ID NO: 404524 - DNA, 605 bp, Homo sapiens
  misc_feature: GZ8MTXP01EGJKH.39.86.H09.1.454.CMB.2.raw
  modified_base (210)..(210): a, c, t, g, unknown or other
  modified_base (228)..(228): a, c, t, g, unknown or other
  modified_base (258)..(258): a, c, t, g, unknown or other
  modified_base (299)..(299): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcacntctcctgcactggaaccngcagtgacgttggtagttatactatgtctntgtacacatcaccaggacaaacgtcccaaatgatgatttangagtcactaaacgcctagtaggttcaatcgtccttctctgctccaaagtctggacaaccacggccctccgtacgacctattccgtcgtcgggtcctacgacggtctaggacggaacgcggtctcttactagtttacttcgggactacgtctactaataacgtaaccgtaagtcctaatttaagtcccgttaacgtttgggggttaacggttcggggaccggggaacggttacccgtaccgtacgttacccggttcgttaacgggtcacgtaaccgaacggtccgttccgtccccgttcggttcccc

SEQ ID NO: 404525 - DNA, 590 bp, Homo sapiens
  misc_feature: GZ8MTXP01B9O15.39.86.H09.1.454.CMB.2.raw
  modified_base (304)..(304): a, c, t, g, unknown or other
  modified_base (500)..(500): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacggttggggtatgactatgtctctggtacagcaatatccaggcacacgacccccaaatcatctatttagngagtcagtactccgcctcgtagggtttccaagtcgtcttctcgtcggtcctcgtaaagtcctagggaccaaccaccgggtccctcccgtacgtaccctactctacgtcgggtcctccgaggtctaggacggacgaggtctagtattacttactcgactacgtctctagtttcgacctaagtcgtaagtgtaacgtntttagtcggttacgttacgggaacgttacgggaccttaaagggtctacgtttccgtaccgtaggttaccaacggttccccgtaaacccgg

SEQ ID NO: 404526 - DNA, 585 bp, Homo sapiens
  misc_feature: GZ8MTXP01CHWDL.39.86.H09.1.454.CMB.2.raw
  modified_base (216)..(216): a, c, t, g, unknown or other
  modified_base (342)..(342): a, c, t, g, unknown or other
  modified_base (568)..(568): a, c, t, g, unknown or other
  modified_base (575)..(575): a, c, t, g, unknown or other
  modified_base (577)..(582): a, c, t, g, unknown or other
  modified_base (584)..(585): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacggttggggttatgactatgtctcctggtaccagcaatatccaggcacacgccccaaatcatctatttangagtcagtactcgcctgtagggtttctatcgtcttctcgtggctacagtctggaccaacgaccggccctcccgtgaccattcctcgtcgggcctccgaggctggaggacgagctagtattactacngcacgtctcgtattgaactaatcgaggtgacgtcttagtcggttacgtagggtagtacgggaccgaaggttccacgttccgtaccgttaacggcctaaccggacccgaaccggacccctaacccgtacgtcggtacctaccgttcccttacccgttccccacccttcctacctacgtacgtcggaccgtacgtcggaacggcgggttcacggggacgaacgggccngttaagngnnnnnngnn

SEQ ID NO: 404527 - DNA, 541 bp, Homo sapiens
  misc_feature: GZ8MTXP01DSVZ9.39.86.H09.1.454.CMB.2.raw
  modified_base (224)..(224): a, c, t, g, unknown or other
  modified_base (267)..(267): a, c, t, g, unknown or other
  modified_base (295)..(295): a, c, t, g, unknown or other
  modified_base (301)..(301): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcatcacatctcctgcactgaacngcagtggacggttggggtatgatatgtctctgtacagcaatcncagcacacgaccccaaatcatctattangagtanagtactcgcctgtaggtttccaatcgtcttctctagacctcgtaagtctacggaccaaaccgccggtccctccctacgtacctacgtcctcgtcggtcctaccgaggcgtaggacggtacgaggtactagtatttaactacgtcgacagtctactatttacgactaagtcgtagcgaagttcttagtgttcgtaggacgttaggacttagtctagtcgtcgtgttacaaccgcgaacccg

SEQ ID NO: 404528 - DNA, 719 bp, Homo sapiens
  misc_feature: GZ8MTXP01EJ1O9.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgacggttggggtatgactatgtcctcgtggtaccagtacaatacgtccaggccaaccaccgaccccctaaatcaatactaatttagcggtaacgttacaaggttaactcccggtacccttacggtacggggttttacccaagttcggtacctttcgtccgtcgggtacccttaaccgtaaagttcccgtacgggaaccctaaaccccggtaccccgggtccccttaccccgtaacggtacccttaacgttcccgtaccggttccgggtacccttaccccgggaagggtcccgtagggaaccgggacggtaacgggtaccttaaggttaactttaacgtttaccgcggtacctaacgttcctacgttatttacggacctaaagtccgtaaggtcgtaagggttctttacggtcgttacgtacggggtaacgttcgggaaccttaggtccacgttcgtcgttacggactaacccgaacccgaaacccgg

SEQ ID NO: 404529 - DNA, 629 bp, Homo sapiens
  misc_feature: GZ8MTXP01C0OHS.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctcgcctccgtgtcgtgggtctctaggacagtcgatcaccatctctgcacttgaaccagcaggtgtacgggttggggttatgacttatcgtctccgtaggtaccagacaatatccgaggcaccaccgacccccaaactcatactaatttagaggagttacagtacgtccgaccttgtacgggttcctaacgtcgtctttctcgtacgacctcgtaaacgttcgtacggactaaccgaccggtcctcccgacgtacctacgtctcgtcgggtcctacgcggtcgtaggacggacgacggtactaggttaactttaactcgtagacacgtccttagtatttacgactaacgtacgtaggtccgaagtttcttagtttcggacgtttacgggaagggttacggttacgttaacggttcctaacgtccgtacgttacgaccgtaaccgaacccgtaaacccg

SEQ ID NO: 404530 - DNA, 724 bp, Homo sapiens
  misc_feature: GZ8MTXP01CTMEH.39.86.H09.1.454.CMB.2.raw
  modified_base (230)..(230): a, c, t, g, unknown or other
  modified_base (265)..(265): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctcgcctccgtgtcgtgggtctcgtaggacagtcgatcaccatctctgcactggaaccngctagtgtacggttggggttatgactatgtctcgnggtaccagcaatgtccaggcaaccaccgaccccctaaatcatactaatttagagtacgttacaagtaacgtcccggtccccgtaggttacggggtttaccctaacgttcgtccgtttacgtcgtacgtactaaccgaagttcgtacggactaaaccgcccggtccctacccgtacgtaccagttccgtcggtcggtacccgtacgacgggtcgttacgggaaacggtacggtaacggttacgttacgttaacggttttaaacttacgtacggtacctaacgttccttaacgttacgttttaacggaacttaaaccgttagtaaccgggttgttaacggttactttaggttaccgttccgggtttaaacgggaacgggtttaccgggaacccgttaagggtaacctacggtttaaccgtacccggttagttacccgtaaccggaaccccgtaaaccccgg

SEQ ID NO: 404531 - DNA, 594 bp, Homo sapiens
  misc_feature: GZ8MTXP01DGK0Y.39.86.H09.1.454.CMB.2.raw
  modified_base (308)..(308): a, c, t, g, unknown or other
tcagtcgcactagtcacgaccggtgctcgatttagtgctatagacttgggtttgggggggtctcaggaggcagcgctctcaggacatctccaccatggcctggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaaatatccaggcacacgcccccaaaactcatcatttacngagtcaggtaatccggccctgtaggggtttccaatcgtcttctctacggctcgaagtcctacggccaaaccgcgggtccctccctcgacctacttccgcgtcgggccaccgacggtcctggaacgggcgaacgggtcctggtaaagtttacttaacgtgcctaagtcctagttatttgacctaaagtctaaggtgtaaggtccttaggttcgttacgttacgggtaagttacggggttaccaagggtccaagttcggtacccttgggacctaacgaacccgaaccg

SEQ ID NO: 404532 - DNA, 699 bp, Homo sapiens
  misc_feature: GZ8MTXP01APDEY.39.86.H09.1.454.CMB.2.raw
  modified_base (230)..(230): a, c, t, g, unknown or other
  modified_base (253)..(253): a, c, t, g, unknown or other
  modified_base (268)..(268): a, c, t, g, unknown or other
  modified_base (330)..(330): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcaggctgcctccgtgtctgggtctctaggacagtcgatcaccatctcctgcacgtggaaccngctagtgtacgggtttggggtangactagtgtctccgnggtaccagtacaatactccgaggccaacaaccgaccccctaaatcaagttacctaatttagngacgtactaagtaacgtccggtcccttaggtacggttttaccaacttcgtctttctcgtacggactcccgaagtccgtacggaaccctacgtaccggtccccttaccgacgtaccctagttccgtccgtacggggtaccctacccggaaggttcccgtaaggggaacggtaaaccgggtcggtacccgtttacggtaagtttactttaaacgcgggtaacctcggtaacccgttttacgtaacgtttacgaacgtaacgtacggttagtacggttaacgttacgtttaggttacgttacggtaacgggtaacggttacggaacgttagtcgtacgtccgtacgtacgaccgtaaccgttaaccgaaccg

SEQ ID NO: 404533 - DNA, 733 bp, Homo sapiens
  misc_feature: GZ8MTXP01EWB9N.39.86.H09.1.454.CMB.2.raw
  modified_base (242)..(242): a, c, t, g, unknown or other
  modified_base (244)..(244): a, c, t, g, unknown or other
  modified_base (265)..(265): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggntnttatatatgctcgtgtccaangcatcaggcacgccgaccccgtaaatctttaaatttgtgtacgtttctttcggcgtccctgtagggtttctacgtccgtcttccgtccgctacccgaagtcgtacgggaccaaaccgtcccggtccccttcccgtacgtaaccctacttcctaccgtaaacgtacccgttccgaacgggtcgttacggggaacgggaaccggtaacggggtaccttaacggtaaacctttaagtttaaacggtttcggaacctacggtacctttacgtaaacgttaactttaaccgttaaggtaaacggtttacctaaaggttccgggttaaccttcccgtaacggtttcgggtccgttttacgggggttccggggaacggggttaacggggttaacccttaaagggtttaacccggtaccccggttaaccggttaacggggtacccaaccgggtaaccccgttaacggggtcccccg

SEQ ID NO: 404534 - DNA, 601 bp, Homo sapiens
  misc_feature: GZ8MTXP01BAWUL.39.86.H09.1.454.CMB.2.raw
  modified_base (228)..(228): a, c, t, g, unknown or other
  modified_base (247)..(247): a, c, t, g, unknown or other
  modified_base (372)..(372): a, c, t, g, unknown or other
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaacngcagtgacgttgggggtangactatgtctctggtaccagcaatactccaggcacacgacccccaaactcatctatttatgagtcaagtaactcggccctcgtaggggtttacctaagtcgtacttctctggcttccgaagtccnggtacccaaacgccggtccctccctacgacctatctcgtcggcttaccgaggctacgggaggaccgtaggtctagttagtttaattcgtacgtcgtaacgtctacttactttagacctaaatcgtagtgtaacggtcttaattcggttacgttacgggaacgggttcggaacgttacgggtctacgttaaccggtcgttacgttaccgtaaccggaacccgaaccccgg

SEQ ID NO: 404535 - DNA, 626 bp, Homo sapiens
  misc_feature: GZ8MTXP01EF6RR.39.86.H09.1.454.CMB.2.raw
  modified_base (214)..(214): a, c, t, g, unknown or other
  modified_base (256)..(256): a, c, t, g, unknown or other
  modified_base (269)..(269): a, c, t, g, unknown or other
  modified_base (345)..(345): a, c, t, g, unknown or other
  modified_base (614)..(614): a, c, t, g, unknown or other
  modified_base (616)..(624): a, c, t, g, unknown or other
  modified_base (626)..(626): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgaactggaaccagcagtgacgttggggttatgactatgtctcctggtaccagcaatatccaggcacagcccccaaatcatcatttangaggtcagtaatcggcctcgtaggggtttctaatcgtcttcnctggctcaagtcnggacaacgacgccctcctgaccatctcgtcgggctccgaggctaggacggacgagggtctaggtatttacgttacngcacgtccttacgtatttcgactaaaacttcgtaagtcggtaacggttctttatcggttacgtttacggggtaaacggttcggggtaaacctaagggttctacgttaccgtaccgttaacgggtaccaacgaccccgaaacggacccccaaaccccgtacttcgtaccgtacgttaccttccgttaccccctaacccttcctacctacgttaacggtcgaccgtaacgtcgggcggaaccgggtgttacgggacaacgggccattaagngnnnnnnnnngn

SEQ ID NO: 404536 - DNA, 619 bp, Homo sapiens
  misc_feature: GZ8MTXP01BFW7F.39.86.H09.1.454.CMB.2.raw
  modified_base (212)..(212): a, c, t, g, unknown or other
  modified_base (266)..(266): a, c, t, g, unknown or other
  modified_base (609)..(619): a, c, t, g, unknown or other
tcagtcgcactagtcacgaccggtgctcgatttagtgctatagacttgggtttggtggtccccagtctgccctgactcaggctgcctccgtgtctgggtctctaggacagtcgatcaccatctcctgcactggaaccagcagtgacgttggggtatgactatgtctctggtaccagcaatatccaggcacacgcccccaaatcatcatttangagtcagtaactcgcctgtagggtttctatcgtcttctcgtgcctacgaagtcnggaccaacgaccggtccctcccgtacgacctatccgtcgtgggacctccgaggtcgtaggacgggtacgtacggtcttagtactttaactacgtcgtacacggtcttacgttatttacgactaaaacgttcgaaggttacgtaggttacctttagtacggttcgtaacggggtaacgtacgggaactacggtctagtccgtacgtagtaccacgacccgaagacccctaacctattccgtacgtaccttccgttcccgttacccccgcctaccgtacctaacggtccggtagtcccggaagttcgggccggccgggcgttacgggacgacgggctcaaagttnnnnnnnnnnn

SEQ ID NO: 404537 - DNA, 774 bp, Homo sapiens
  misc_feature: GZ8MTXP01EB6DN.39.86.H09.1.454.CMB.2.raw
  modified_base (236)..(236): a, c, t, g, unknown or other
  modified_base (259)..(259): a, c, t, g, unknown or other
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctcgccctgactcaggctcgcctccgtgtcgtgggtctcgtaggacagtcgatcaccactctcctgcactaggaaccngcaggtgtacgggttggggttangactagtgtctccgtaggtaccagactaatactaccgaggaccaaccgaacccgaaccccctaaaactctaactttacgttaagttttacgtaggtaacggtttactaaaggttaaccgttccccgggtaccgttacggttaacggggttttacccctaacggttccgtctttcgtccgttacggtacctccgtaagtccgtacggaccaaccggtacccggtccctacccgtacgacctacgttccgtcggtcggtcccttaccggacggtcgaagggacggaaccgtaggtacttaggtttaactttacgttacgtcgtaacggtctaccctttagttacgtttaacgtaacgttaacgttacgttaacgggttacggttaacggttttacgtttaacggtttacgggtttaacgggtaaacgggtaacgggttaaccgggttaacgttacggttaaccgttacgttcccggttaacggtacggttacccgaacccggttaaccccgtaaccg

SEQ ID NO: 404538 - DNA, 597 bp, Homo sapiens
  misc_feature: GZ8MTXP01A90W4.39.86.H09.1.454.CMB.2.raw
  modified_base (225)..(225): a, c, t, g, unknown or other
  modified_base (245)..(245): a, c, t, g, unknown or other
  modified_base (258)..(258): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactgaacngcagtgacggttggggttangatatcgtctcgnggtacagacaatactcgaggcacacgacccccaaatcatctattatgagtcagtactccgacctgtacgggtttaccagttcgtcttctcgttcgcttccgaagtctacgggacctaacgaccgtccctaccctagacctatcctacggtcggctaccgaggtcacggacgacgaacgtctacggtaactttactacgttgaccctagtccctactatttcgactaactcgacgtgaacggttcttagttcggttacgttaacggggaagttacccgggaccttaaagggttcctacgttccgttaccgtacggttacctaacccggaaccccgaaccg

SEQ ID NO: 404539 - DNA, 687 bp, Homo sapiens
  misc_feature: GZ8MTXP01A1N2N.39.86.H09.1.454.CMB.2.raw
  modified_base (230)..(230): a, c, t, g, unknown or other
  modified_base (243)..(243): a, c, t, g, unknown or other
  modified_base (252)..(252): a, c, t, g, unknown or other
  modified_base (254)..(254): a, c, t, g, unknown or other
  modified_base (269)..(269): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgacgactcctggacagtcgatccaccatctcctgcacgtgaaccngcagtgacgttgngcttatatntntctcgtgtaccaacngcatcgaggtcacgcccgaccccgtaaattctttaaattagtgtacgttccgtttaccggccgtacccttggtaggggtttccacggttcccgtctttcccgtcccgtccttaacccgtaacgttcgtacggaccctaaaccgtccccgtcccgttcccctaggaacccctattcctaccgtaaacgtccctccggaaggtcgtacgggaacggtaccgaggttaccctaggtaaactttacgttagggtacgtaccctaagggtccttaacgtaacttaaggttaccgtaaaggtaacgttactaaacgttcgtaaccgtccgtaacggttggtaccgttggggtaccggacggttaacggttaccgttagttccggaccgttcgtacggtaccaccggtaacgaaccggttccccg

SEQ ID NO: 404540 - DNA, 554 bp, Homo sapiens
  misc_feature: GZ8MTXP01EJGPV.39.86.H09.1.454.CMB.2.raw
  modified_base (251)..(251): a, c, t, g, unknown or other
  modified_base (264)..(264): a, c, t, g, unknown or other
  modified_base (277)..(277): a, c, t, g, unknown or other
  modified_base (400)..(400): a, c, t, g, unknown or other
  modified_base (421)..(421): a, c, t, g, unknown or other
  modified_base (426)..(426): a, c, t, g, unknown or other
  modified_base (477)..(477): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtcctggggtctctaggacagtcgatcaccatctcctgcactggaaccagcagtgacggttgggggttangactatgtctccnggtaccagcaatntccaggcacacgaccccaaatcatactatttactgacgtcagtaatccggcctagtaggggttttccaattcggacttcgtctcggctccgaagtcctagggcaaaccgtaccggccctcccncgaccatcgtctgggctacgngtacngacggacgaggtactagttattacttacgtgctagctctagttcactaatnagtcgaaggtcttagtcgttgtacgggtaagttcgggaccttaggtctagtccgtatcggctaacggccctaaccgg

SEQ ID NO: 404541 - DNA, 735 bp, Homo sapiens
  misc_feature: GZ8MTXP01EI2JX.39.86.H09.1.454.CMB.2.raw
  modified_base (225)..(225): a, c, t, g, unknown or other
  modified_base (236)..(236): a, c, t, g, unknown or other
  modified_base (280)..(280): a, c, t, g, unknown or other
  modified_base (312)..(312): a, c, t, g, unknown or other
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacgacgggtcctcgggcccagtctgccctgactcaggctcgcctccgtgtcgtgggtctcgtaggacagtcgatcacctatctctncactaggaccngcagtgacggttggggtatgactagtcgtcctcgtggtacaganaatcgaccaggacaccaaccgaccccaaactnacttactaatttagacgaacggttacaacggttacctccggtacccttagggtacggggtttaccctacggtccgtcgttcccgacccggtacttaacccgtaaggtcctacgggacctacccgccggtccctccgtacacctattctactacggacctccgaagtccgtagggaacccgtagtacgtcgttaacgtaacctttaacggtttagtacggtaaccgtaacgttcttaaaccttaaggttacccttaaagttaccgtaaggtaactaacggtcgttaaacgttccccgacgggtttagggttccgtacgggggtttaccgggaaacgggggttaccgggttaaccgttaaacggggttctaacccccgggtttggttaaccggggaccctaaccggttaaccccgggtaaccggg

SEQ ID NO: 404542 - DNA, 625 bp, Homo sapiens
  misc_feature: GZ8MTXP01BT9FT.39.86.H09.1.454.CMB.2.raw
  modified_base (295)..(295): a, c, t, g, unknown or other
  modified_base (305)..(305): a, c, t, g, unknown or other
tcagtcgcactagtcacgaccggtgctcgatttagtgctatagacttgggtttgggggggggtctaaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactgaaccagcagtgacgttgggggttatgactatgtctcctggtaccagcaatatccagcacacgacccccaaancatcatttangagtcagtactcggcctagtagggtttctaatcgtcttctctggactccaagtctggaccacgaccgcctccctgaccatctctcgggactcgaggtcgtgacgggtacgacggtatacgtaagtttacttaacgtggtaacctagtccgttaccgtaattttcggaaccttaaagtccgtaacggttcggtaaggttaaccgtttaattcgggttaaccgtttacgggaaagggttacgggggaacccttaaaggggttctaacggttcccgtaacgttaacggggtcaacccgggaacccgttaacccgggaaccccc

SEQ ID NO: 404543 - DNA, 560 bp, Homo sapiens
  misc_feature: GZ8MTXP01EM7ZA.39.86.H09.1.454.CMB.2.raw
  modified_base (228)..(228): a, c, t, g, unknown or other
  modified_base (260)..(260): a, c, t, g, unknown or other
  modified_base (273)..(273): a, c, t, g, unknown or other
  modified_base (304)..(304): a, c, t, g, unknown or other
  modified_base (336)..(336): a, c, t, g, unknown or other
  modified_base (370)..(370): a, c, t, g, unknown or other
  modified_base (376)..(376): a, c, t, g, unknown or other
  modified_base (382)..(382): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggtatgactatgtctcnggtaccagcaatnccaggcacacgacccccaaatcatctattangagtcagtatcgcctgtagggtttccaatcgnttctcgtcgctcagtcgagacaacgcggcctccngacctntctcgngggctcgagctggagacgagctagtagtttacttacgtgactacgtccttcgtagtttagacctaaagttccgaggttgaaggttactttaggtcgttacgttacgggtaaggttacggaccgttaacgggttcctacgtccggtacgtacggttaccaaccgttaacccgaaacccg

SEQ ID NO: 404544 - DNA, 588 bp, Homo sapiens
  misc_feature: GZ8MTXP01DSX33.39.86.H09.1.454.CMB.2.raw
  modified_base (192)..(192): a, c, t, g, unknown or other
  modified_base (226)..(226): a, c, t, g, unknown or other
  modified_base (240)..(240): a, c, t, g, unknown or other
  modified_base (257)..(257): a, c, t, g, unknown or other
  modified_base (270)..(270): a, c, t, g, unknown or other
  modified_base (397)..(397): a, c, t, g, unknown or other
  modified_base (473)..(473): a, c, t, g, unknown or other
  modified_base (513)..(513): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgagctcnggacagtcgatcaccatcctcctgcactgaaccngcagtgcgttggtncttaataattatgtacncctgttccaaacngctatcaggcacgcgccccgtaaaattcttaaattctagtacggttctttacgtcgcccgttcaggggtttctacgtccgtcttcctccggcttaaccagtctaggcaaacgacgcctcgtcgactntctacgtagaccttcaaagggctaggtaacggactacgggacttacgacttaagtttcgtacggctacgcctttanaagttacgtacgtagtaacttacaagtcggtactaaccgnggttcgtcgttgggtaccggagggttaacggacttaggtccggtaaccgttcgtacggcacgtcccgaagggtcc

SEQ ID NO: 404545 - DNA, 532 bp, Homo sapiens
  misc_feature: GZ8MTXP02IH3L8.39.86.H09.1.454.CMB.2.raw
  modified_base (226)..(226): a, c, t, g, unknown or other
  modified_base (370)..(370): a, c, t, g, unknown or other
  modified_base (415)..(415): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggttatgactatgtctcctggtaccagcaatatccaggccacacgcccccaaatcatcatttatgagtcagtaatcgccctgtaggggtttcctaagtccgtcttctctggctccaagtctggaccaacncggcctccctgaccatctcgtcggcctcgacggctgacgggacgngcttagtaatttattctgctagtctctatttgactaatcagtgacgtcttagtcgttacgtacggacgtacgggaccaaagggtcacgttcgtacgtacggtcacggaccaaaccgg

SEQ ID NO: 404546 - DNA, 478 bp, Homo sapiens
  misc_feature: GZ8MTXP02HZYMV.39.86.H09.1.454.CMB.2.raw
  modified_base (472)..(478): a, c, t, g, unknown or other
tcagtcgcactagtcacgaccggtgctcgatttagtgctatagacttgggtttgatggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacaggctgattattactgcagctcatttgcatcagtgaggcttatgtcttcgaagtgggaccaaggtcatcgtcctaggtcagcccaaggcccaaacccatgtcactctgttcccaccctctcactagtgcgactgagcgggctggcaaggcgcataagnnnnnnn

SEQ ID NO: 404547 - DNA, 525 bp, Homo sapiens
  misc_feature: GZ8MTXP02J2LNG.39.86.H09.1.454.CMB.2.raw
  modified_base (301)..(301): a, c, t, g, unknown or other
  modified_base (318)..(318): a, c, t, g, unknown or other
  modified_base (367)..(367): a, c, t, g, unknown or other
  modified_base (412)..(412): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttangagtcagtatcggcctnagggtttccaatcgcttctctggctccaagtctggcaacacggctcccngaccatctctgggctccgagctgagggacaggctgattagttacngcagtctactattcgactaatcagtgacggtcttagtcggttacgttacgggaacggtcgggtaaccgtaaggtctaacgttccggtaccgtacggtccaacgacccgaacgg

SEQ ID NO: 404548 - DNA, 521 bp, Homo sapiens
  misc_feature: GZ8MTXP02I8Q4Y.39.86.H09.1.454.CMB.2.raw
  modified_base (301)..(301): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcttcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgcccccaaatcatcatttangagtcagtaatcgcctgagggtttcctaatcgcttctctggctccaagtctggcaacacggcctcctgaccatctcgtgggcctccaggctgaggacgaggctgtattatactgcagctctatttgactaatcaagtgacggtcttaatcggttacttacgggaagttcggggaacctaagggtctagttccgtaccgtaggtccaacggcccaaaccgg

SEQ ID NO: 404549 - DNA, 493 bp, Homo sapiens
  misc_feature: GZ8MTXP02JY8U8.39.86.H09.1.454.CMB.2.raw
  modified_base (301)..(301): a, c, t, g, unknown or other
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttangaggtcagtaatcggccctcaggggtttcctaatcgcttctctggctccaagtctggcaacacggcctccctgaccatctctgggctccgaggctgaggacgaggctgattattactgcagctcatttgcaatcagtgaggcttatgtcttcggaagtcgggaccaaggtcagtcgtcaggtcagcccaacg

SEQ ID NO: 404550 - DNA, 494 bp, Homo sapiens
  misc_feature: GZ8MTXP02H4DRK.39.86.H09.1.454.CMB.2.raw
  modified_base (356)..(356): a, c, t, g, unknown or other
  modified_base (483)..(483): a, c, t, g, unknown or other
  modified_base (487)..(494): a, c, t, g, unknown or other
tcagtcgcactagtcacgaccggtgctcgatttagtgctatagacttgggtttgatggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggccctcaggggtttctaatcgcttctctggctccaagtctggcaacacggcctcctgaccatctctggctccaggctgaggacgaggctgattatactgcagctcatttgcatcagtgaggcttagngttcttcggaaagtgggaccaaggtcatcgtcctaggtcacgcccaaggcccaaaccccactcgtcactctcgttcccaccctcctcactacgtgcgactcgacgcgggactcggcaacggcgacanaagnnnnnnnn

SEQ ID NO: 404551 - DNA, 515 bp, Homo sapiens
  misc_feature: GZ8MTXP02H30PA.39.86.H09.1.454.CMB.2.raw
  modified_base (217)..(217): a, c, t, g, unknown or other
  modified_base (236)..(236): a, c, t, g, unknown or other
  modified_base (256)..(256): a, c, t, g, unknown or other
  modified_base (342)..(342): a, c, t, g, unknown or other
  modified_base (360)..(360): a, c, t, g, unknown or other
  modified_base (390)..(390): a, c, t, g, unknown or other
  modified_base (506)..(506): a, c, t, g, unknown or other
  modified_base (508)..(515): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcccaatatccaggcacagcccccaaatcatcatttangagtcagtaatcggccctnagggtttctaatcgctttcnctggctccaagtctggcaacacggcctcccctgacccatcctctgggctccaggctgaggacgaggctgattatactgccagcctnatttgcaatcagtgaggnttatgtcttgtaagtaggacgaaggtacancgtctagtcacgacccacgaccaaaccccactactctactctcttccctaccctaccctccactacgttcgcgaccgtacgacggcggcgtcggacgaacggacgacgaacgtagngnnnnnnnn

SEQ ID NO: 404552 - DNA, 546 bp, Homo sapiens
  misc_feature: GZ8MTXP02H7GJE.39.86.H09.1.454.CMB.2.raw
  modified_base (302)..(302): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacgttggggtatgactatgtctcctggtaccagcaatatccaggcacacgacccccaaatcatcatttangagtcagtaatcgccctgagggtttccaatcgtcttctctggcctcaagtctgacaacgacggcctccctcgaccatctcgtggcctcgagctgaggcgagctgattattactgacagtctactatttgctaatcgagtgaacggtctttagtcgttacgttacgggaagttacgggaacccgtaaagggtcctacgttaccggttaccgtacggttaccgaacggtacccccgaaaacccggg

SEQ ID NO: 404553 - DNA, 491 bp, Homo sapiens
  misc_feature: GZ8MTXP02HRQW8.39.86.H09.1.454.CMB.2.raw
  modified_base (322)..(322): a, c, t, g, unknown or other
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgagactcctggacagtcgatcaccatctcctgcactggaaccagcagtgacgttggtgcttataattatgtctcctggttccaacagcattcaggcagcgacccgaaactcttaatttatgaggttctttcgtcggcctnaggggtttcagtcgcttctccggctccaagtctggcaacaccggcctcctgacccatctctagactccagctgaggacgagctgacttattattgcagctcatatactgaagtcaatgtatcactggctgttcgcgaggacaagttcgcgtctaggcacgcctaaggcc

SEQ ID NO: 404554 - DNA, 482 bp, Homo sapiens
  misc_feature: GZ8MTXP02GDGIH.39.86.H09.1.454.CMB.2.raw
  modified_base (236)..(236): a, c, t, g, unknown or other
  modified_base (473)..(473): a, c, t, g, unknown or other
  modified_base (475)..(482): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctnagggtttctaatcgcttctctggctccaagtctggcaacacggcctccctgaccatctctgggctccaggctgaggacgaggctgattatactgccagctcatttgcaatcagtgagcttatgtcttcggagtggaccaggtcatcgtctaggtcacgccaggccaaacccactgtcactctcgtcccaccctcctcactacgtgcgactgacgtcgggctcggcaaggcgcatagngnnnnnnnn

SEQ ID NO: 404555 - DNA, 519 bp, Homo sapiens
  misc_feature: GZ8MTXP02FJQ1Q.39.86.H09.1.454.CMB.2.raw
  modified_base (323)..(323): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctnaggggtttctacgtcgcttctccggctccaagtctggcaacacgccctcctgacccatctctacgactccaggctgaggacgagctgactattattgcagctcatatactagaagtcaaatgtaatccacgtggctggttcggcggtacgggacctaaggtcgaccgttcgtacggtcacggccccgaaggtcccg

SEQ ID NO: 404556 - DNA, 520 bp, Homo sapiens
  misc_feature: GZ8MTXP02IOL84.39.86.H09.1.454.CMB.2.raw
  modified_base (319)..(319): a, c, t, g, unknown or other
  modified_base (379)..(379): a, c, t, g, unknown or other
  modified_base (419)..(419): a, c, t, g, unknown or other
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagccccaaactcatcatttatgagtcagtaatcggccctnaggggtttcctaatcgcttctctggctccaagtctggcaacacggcctccctgaccatcnctggctcaggctgagacgaggctgattattactgcagctnattgacaatcagtgacggtctttagtcgttacgttacgggtaacgtacgggaacctaaaggtcgtacgttccgttaccgtaggtccacggacccgaaacgg

SEQ ID NO: 404557 - DNA, 532 bp, Homo sapiens
  misc_feature: GZ8MTXP02JOHHL.39.86.H09.1.454.CMB.2.raw
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctctggttccaacagcattcaggcagccgccccgaaactcttaatttatgtagttctttcgtcggccctcgtaggggtttcacgtcgcttctccggctccaagtctggcaacaccggcctccctgacccatcctctacgactccagctagaggacgaggctagacttagttatgcagtctacatatactgaacgtcaaagtggtactccacgtggcttggttcggcggacggtaccaaggttcgaccggttctacgggtacacgacccgaaggtcccg

SEQ ID NO: 404558 - DNA, 523 bp, Homo sapiens
  misc_feature: GZ8MTXP02FNITW.39.86.H09.1.454.CMB.2.raw
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttatgaggtcagtaatcggcctcaggggtttcctaatcgcttctctggctccaagtctggacaacacggcctccctgaccatctctgggctccaggctaggacggacgaggctagatttatactgcagctcatttgacaatcagtgaaggtcttatgttcgttacggtaaggtacgggaccgaaaggtctaacgtcgtcccgtaggtacgacgacccgaaacccgg

SEQ ID NO: 404559 - DNA, 482 bp, Homo sapiens
  misc_feature: GZ8MTXP02HYVZT.39.86.H09.1.454.CMB.2.raw
  modified_base (359)..(359): a, c, t, g, unknown or other
  modified_base (437)..(437): a, c, t, g, unknown or other
  modified_base (476)..(482): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattatactgccagctcatttgcaatcagtgagcttangtcttcggagtggaccaaggtcatcgtctaggtcagcccaaggcccaaacccactgtcactctcgttccccacctccncactagtgcgactgacgcgggctggacaaggcgcatagnnnnnnn

SEQ ID NO: 404560 - DNA, 504 bp, Homo sapiens
  misc_feature: GZ8MTXP02F0GTU.39.86.H09.1.454.CMB.2.raw
  modified_base (304)..(304): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaatcatcatttangaggtcagtaatcggcctcgaggggtttcctaatcgcttctctggctcaagtctggacaacacgcctccctgaccatctctgggctcgaggctgaggacgaggctgattatactgcagctcatttgctaatcagtgagtcttatcgttcgttacggaacgtcggaccaaggtcagtcgtacctaggtcacgcccaaacgg

SEQ ID NO: 404561 - DNA, 481 bp, Homo sapiens
  misc_feature: GZ8MTXP02FQ7A7.39.86.H09.1.454.CMB.2.raw
  modified_base (324)..(324): a, c, t, g, unknown or other
  modified_base (351)..(351): a, c, t, g, unknown or other
  modified_base (480)..(481): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggccctcagggtttctaatcgcttctctggctccaagtctggcaacacggcctcccctgaccatctctgggctccaggctgaggacgaggctgatnttactgccagctcatttgcaatcagtnaggcttatgtcttcggaaagtgggaccaaagggtcatcgtccctaggtcagcccaaggccaaacccccactgtcactctgttccgcccctcctcactagtgcgactgagcggctggcaaggcgcatagnn

SEQ ID NO: 404562 - DNA, 535 bp, Homo sapiens
  misc_feature: GZ8MTXP02GNSHQ.39.86.H09.1.454.CMB.2.raw
  modified_base (227)..(227): a, c, t, g, unknown or other
  modified_base (304)..(304): a, c, t, g, unknown or other
  modified_base (378)..(378): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatccaggcacacgcccccaaactcatcatttangaggtcagtaatccgccctgtaggggtttcctaatcgcttctctggctccaagtctggcaacacggcctccctnaccatctctgggcctcaggctgaggacgaggctgattattatgcagcctactatttcgactaatcgagtgtacggtcttagtcgtacgttacgggaaaggttcgggaacctaagggtcctaagttccgtaccgtaggtaccacgaccccaaaccggg

SEQ ID NO: 404563 - DNA, 503 bp, Homo sapiens
  misc_feature: GZ8MTXP02I4KKL.39.86.H09.1.454.CMB.2.raw
  modified_base (300)..(300): a, c, t, g, unknown or other
  modified_base (311)..(311): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagcaatatccaggcacacgcccccaaatcatcatttangagtcagtaancggccctgaggggtttcctaatcgcttctctggctccaagtctggcaacgacggcctccctgaccatctctgggctccgaggctggaggacgaggctgtattattactgacagctcatttgactaatcagtgagtcttatcgtacttacggaagttcggaaccaaggtcatcgtctagtcacgacccaacgg

SEQ ID NO: 404564 - DNA, 534 bp, Homo sapiens
  misc_feature: GZ8MTXP02H3MIX.39.86.H09.1.454.CMB.2.raw
  modified_base (302)..(302): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctctcactcagggcacagggtcctgggcccagtctgccctgactcaggctgcctccgtgtctgggtctctaggacagtcgatcaccatctcctgcactggaaccagcagtgacggttggggttatgactatgtctctggtaccagcaatatccaggcacacgcccccaaatcatcatttangagtcagtaatcggcctgaggggtttcctaatcgtcttctctggcctcaagtctggcaaccacggcctccctgaccactctctcgggctccgaggctggaggcgaggctgtatttattacgtgctagctacgatttgactaaatcgagttacgtaggtactttagtcgttcgttacggaagtacgggaacctaaggtccagttccgtactacggtcgacgacccgaaaccgg
